United States Patent 11,242,544 (MICROBIOMES AND METHODS FOR PRODUCING MEDIUM-CHAIN FATTY ACIDS FROM ORGANIC SUBSTRATES) - sequence listing, part 13

SEQ ID NO: 728 - DNA, 61408 bp, Unknown
  Metagenome-assembled genome
tggaagggccatcgctcaaacggataaaaaactaaaagctaccctggggataacaggcttatctcccccaagagtccacatcgacggggagggtttggcactccgcgatgtcggctcatcgccatcctggggcggtagtcggtcccaagggtgggtgttcgcccattaaagcggtacgcgagctgggtttcagaacgtcgtgagacagttcggtccctatccgtcgcgggcgagggaaatttgagaggacctgtccttagtacgagaggaccgggatggaaatacctggtgtgaccagttgtgccgccagggcatcgtctgggttagctacgtatggatggtaaacgctgaaagcatctaagtgttgaaacacagcctcgagatgagatttcccattccttttgggaaagtaagacccctgaagatgaaggtagataggtgaagtgggtagagtgcggtgatgcatgagcgactaatactaatcggtcgaggacttaaccacacggggtgaagaggtgttcggttagaatatgagtagattatttgtaactatgttgtgagagcgcaagtgttcacatcgagacatgagttgtggttgatgatggcgaggatatacctgttccatgtcgaacacaaagtaagcttcttaagcgccgagcgtaagagtagttgggggatcgctccctgcgagggtaggacgttgccatgcgattattccgacatagctcagttggtagagcgcttgactgttaatcaagatgtcgacggttcgagcccgcctgtcggagtgacatagatgttggcaattgtgttaacatctatttttatatcatgccggcttagctcagttggtagagcatcggtatcgtaaaccgagggtcatcagttcgactctggtagccggcacttgtgaggtgggacgtggttctcgcctttttatttttaaatagacataaaatgattggcagctttgcgcaaacgcaaagctgcttttttgatataagaatgttagctatttgaatgccgaagtatcaaaatgatcgtaagggcttagtaggatgatgcctattgtcgccactgctttttaggtatgcttagcatatcaatcttgcggtttattataattagtcgcaataactgtaaattacatgctgcgaacaatcatagccattttaatagcggtactttattgttgataatttcagttttgttttttgtttaattagatttttaataccaattgcgtattttcagcatttgaatgctattaattattttatattaaattagaatttagtgttaattttagaaagctaaaagccttataaaatgtcctatcaactagtttttggtgctataaaaggatttaagactatttatgtatggtggatattaatttaattaatggttattagattagaaaacagttagtgctattgttgattaagattaaggctagtataatagttattatgtttaattaagaaacaaaacttgttacttttaaacgaaatacaaactggttaagaagtttggaggaatctctattggataaggaacaaaagctggatcggtcgttctttggccaaccccgtggcttacggacgttgttcttcactgaaatgtgggaacgattcagttactacgggatgcgtgcgctactgatctattacatgtactacagtgtcgctaaaggtggtcttggatttgaccaagtcaccgcagcatccattatgtcaatctattcggccttagtttacgtttctagtgtcctcggtggctttctaagtgaccgtgtctggggtagccgtaagaccgtctttattggtggggtcttcatcatgttaggccacatcgtgttatcaacgccatttggagttggcgcactatttgtttcaatcgcacttattgtcattgggactgggttattaaagccaaacgtctctgacatggttggtcaattgtatacagtagaagatacacgtcgggatgctggttttagtattttcgtcttcgggattaacttaggttcattggttgcaccagccttagttggtcggatcggcttaaatgttaacttccacttaggcttctccttagctgcgattgggatgttctttggtctattgcaatactactttgatggtaagaagaatttaagttctgctagcctctatccaactgatccattagaacccggtgatttgaaaaaaatcatgcggtggacaatcttaggaatcgttgggattgggttgattctactattaatgcaattaatgaatgctcttacgttagcaaatgttattagtttaattagtacgcttgttatcttgacaccaatcgtttactttattttgatgttaacgtctgacaagactaatgcaacagaacgttcacgtgttcgggcttatatcccattgtttattgccgctgctttattctgggcaattgaagaacagggttcgtccgtacttgcgttatttgcagctaatcgggttaatttggatcttggttttacccatctagctgcttctgatttccaaatgctaaacccattgttcatcatgatttatacaacaccattcgtgtggttgtggactaagtggggtaaaaaacaacctagttcaccaactaaatttgcgattgggttgctattcgctggggcttcttacctagtgatggctgtacctggagcgctctttggaactgcagggaaggttagtccatggtggttagttgccagttgggcagtcgttgaaattgctgaaatgttgatttcaccaattggtttatcagttaccaccaagcttgcaccaaaggcttttgcttctcagatgatgagtatgtggttcctaactgattcggttggtagtgcgcttaatgcacagattgtccgtttctactcgacgcaaaccgaagtgccatattttgcgattaccgggattgttagtgtcgttttagggattatcctctttatgatggtgccaatgattaaacggtcgatgcaaggcattcgctaaattgaatatttactcgaagatatgttatcttagtggtagcatatcttttttgttttggaggggttgaccatcgtacgaattgctttcagtagtgataatcattttgatgttaatcgagtggatgcgactgcgatgatgcgatctcaggcgacctatcttttacagaatggtgttcagatttatttgattgctggcgatctttttaatgactttcagcgtagtcagcagtttgtcgtcgatttacaggccctattaggcgcacagacgcgtgtttactggattgcgggtaatcatgacatggtccatggcatttcgtttgacgagcttgaaacagggcattttgatggctacctgcataaccggtatatcgatatttctggtacagattggcgcgtgattggacataatgggtggtatgactatcagtatgctgcccaggtccctgatacgactgcggccgacttcttacactggaagaatgcgttttggatcgaccgggctattaaacagccgatgagcgatcaggagcggactgatttaatgctcaaccaagtaaaagcgcagcttaacttggctgctgtggatcacaagcaagttatttttatgacgcactttgttccccggatcgattatttgcgtttttctgatgataatcggttttggaatatggctaacgcgttaatgggaacgccccggttaggacaactgttggagcagtttaacgtggcgcacgttttatttggtcatttgcacgttcatccgcaaccgcgggtgtttggtcagaccacctattatgaccaagcagtgggctatggactcaagcgtatcaatgaatggcaagccaataattttatggcggagtggtatcaagatacgcaaattctggatttgaaataaaaactgaaaaaactttgaaaaaagtcttgattttttattcaaaattatgtattctaatatagttgaatgatttacggaggggtagcgaagtctggctaaacgcggcggactgtaaatccgctccttcgggttcggtggttcgaatccactcccctccatttcattattgggctatagccaagtggtaaggcaacgggttttgatcccgtgatgcgctggttcgaacccagctagcccaattgttacgcctttcgtcgttaatcaggtcttaggatcttgatgtaacgacttttttattggcttaaatttatcttaatattggcggtagtgccacttcgtgaagaatgcgtaacggattcttcacgaagtggatttttttgtctcggtctgtttatttgccatcatcaataataatgtgatatgttttagtattctatttggggcacgatccagatgggataggaggtctggtcaatgaatttatttattccgtaagtacacggaagaggttaatggctggcattgttaattttaaaaatacgtactagttaacgcgtcatgacggccatcacaattattatgagtcgttcttataaaagcacaccaatttttaaagcacatatgggttatggaaagaagcgcgctaaccgtgctgttcgaaatcgtatgaatcgtggtgaatttgatgttttgccggctaattcgcatgcctggtataaacgatgttatgagcagtatgatgttgtcgattattgctccagagagacttattcgcaagttcaacttgagctggagacgatgcgattagagattactcgtaacggtgggattattcgaagaatcccacaacatctggttgttacgtatacttttgatccggtgatatctgatattgtgcacatgcagcgaacggaagaactaattcctgcgcaagatgtccaaatgtttgtaggtacttttgaacagtggtgtcgggagcgtcgcaactgctgggccaaggcttattatcgaaaataagtcgtattggaacttgatctatgagatttggttgaagaggctacgtatgcgtacccttggttgtcccactaccagccctaactagttgactgaataaatcaaattttccacagaactgttatcaaatgcagtaacggcaggctgtccagcgtcgcaataatgcttgggcagcttttttgcatggcccatatctggattcaaaggcatttacctgccagagatgacgtggttattaagtatatgactagcagtcagttattcagaattataagatgtttattcaatcgaacctcgaaaattgagtttgttagcgttaagcttaatttaagaaatcataccatcatgaataacgtaagcgaccatgatgatgaccaaggaggatttgaaatggcggtaactaaaattgatttaaaaaccacgatgacttaccgggagcatgcaattactagtaaatcatttgctcgaaaattagggattgaactgccgtttgcgatgtacgcaatggcggcgggtgaaagtattagtgctgaacaatccacgctgacccgcttatttgaggttgttgatggtactttgaccgtccgtttggcgacggagaccgaccaagaagtgcatgcgggcgagatgttagtggtgccagctcatacggtccatacgttggtcgctgagcagccgtgccagtttattcaattagaaacgaaataggccttaatagcgagatgcggaggaattcaaatgagtttaattaacaaaattgatcatgctaaggtcctcaatttaactgaacaaattccactggatgatgatcaagttaatagccggacactggttcaacgggatgatttaagtatgacgctattttcagtcgcaaccgaccaagagattggcggccattctgcccagggcgatgcgatggtcaatattttaagtggagaagcggaaattacgattgaaggcaccatttatcatttaactgcgggacaatcgatcgtgattcctaaggatgcccggcacgcgttatatgccgttcaaggatttcagatgttattggtggtcattaaacccgactaatgcacgtggttatcgatgagacggagggagtaatatgccgctgtatacgtttattggtgatattcatagtgccgcggatgatctggcagttttattagccgatcctgaagttaccgcgacgcgcttgattttcttgggcgattatattgatggtacggcggcacgctattttggtcatgccaccgagtcagctccgttggcgccgctaaaagtactgacgatggttagaaaacgggtacgggaatacggcgatgtggctttacttggcaatcatgatgaattttggctacggacagctcatggtgatgacaatgccaccgcaacttgggtgttgaacggtggtcaccggacctggcgcaaattagggatttactcctccaatcccaatcatgttcggcgggcattaaatggtgcgcgattaaagccggatactgatttcttagcacatttgccgctgatgtggcaacatggtcggttactggctatgcacgcgggtgttaactggcaatacccattaacacaacaaacaacgactgacctactgtggattcgggatgactattatgatgacttcacgactggcagtcactgttggcatcggaacttattcaataaagtcatcattactggtcatacgccggtgcagaccttgactggttcacacactggttatttaaagatgcaggcagatgcgcaagacgttccacgatatctaattgatgcaggcagtcgttcaggcctgtttgatggtggaatttgtgcgttaacgctgacggtcgatggtgaatttgtcagggcgaaacgcgtgatcaagggtcaccgctacgatggtcagcaaatcgtcactccggccatgttggtggatcaggcgcactaagtatcactaaacatctcagagatagaacgtaaaaggagcaggctcacatgatattgagactgctccttttatgatgtcacgctagttactggttttcgcactatttcaagttgattggtttgcaagttctcactgaatcgttactcagcgtaactgaattataggtgtaaatagaaccagccaccaaggcctaaaatgaacaggccaagtccattgagggccgtaaacacgatcaaaaaatggtggagtggttgttcatcattgaagggcaacaattgttttaaggcaagcagatttgctagtgaggccaccaatgaccccagaccgccgatgttgacgcctaaaaatagcgctgataaatggggcgtgaaattcgctagtaagatggcggctggaacattgctgatgacttggctagtaattagtccagtaatatagacactgggggctgtctgagttaattggttgagccaatgcgttattgcgggattatgactgatggcgctaacgaagatgaagaagcagataaaggttaagagtagtgcgtaatcaacgtactgaaagacgcgtcggttaatcatgaggcctacgacaatcgttccgataataactagtgaaatgggcaccaaattaaaaatgccaagcataatgaaactgagcaggccgcccgcaagcccgatttgactgcgagaaatgggcgtagatttggttggtgttacagttagcggcaaccgaggtaaccgccggcttaaggcaactaataaagctagactagcaagcattaacggagtcgacaatttaaaaaacgtgaatagattaacgtgatagaacgtgaccaaaaataaattttggggattgccaatgggcgtaaacgcgctaccaagattggctgccatgataattaaagtcgttgggtaggcaatggccaggtgctgccgccgggcgagtgtgagaaagattggaattaacgttaggatcgcaacgtcgttagttaaaatcattgagccaccaaaggccagtaagatgaataattgacacatttgacgggtatcgtgtgatttaactaagagccagtcccttaaagtatcaagcaaatgcatcgcgcgaagtaattgaacactgatcatgagtgcaaataaggtgccaatcgtagcccaattaattgccgtcagttggggtgtcccgatgaacaaacttaaaccagcacaaattaatgcaataataaagattttatcgtgaagtgtgcgacgaacgactgtcaccatggtaaacgtccccctcaatagtcagttaattagttctaacttaaacaaactcgtcgctaaatgtaaactgatagacatttttcagataaggatgtagccacccgaacggtaacccaaataaaaaatcgcttcaaagttatgtgtttaactttgaagcgattagtgcttggttttgattgccagttagcttgcttaatgtgtatctagtttatcttgctgagtgttttgaccgaagaaccacaagtaggcaccatataacgcgttagcgagcatcactagttgcaatgctaacattgaggcggctgcaggactgaagccttttaattggttgaaccagataataacgttaatcacgtcgagtgtgatccacgcaacccattgggaacgataaccgttgaccatgaggacactaccgacaatcccaagtggtaacagggtcgcgtccaggtagatttggttaccgttaagttgtttactaaagtgtaagacaatggcgtagacgagtacggctaacgcgaaccaggcacaaccggctaatttgctcaatttacgaccagtcagttcgctggcatcgggttgcgctgccattttacgatgccagacggtgatgccgacaaattgcatgataaggtaaaatgattgcgacgcaatgtcaccaatcagccgattggtgatggccgtagtaagccaagccgcacaggcaataatgccccaactatagttcgtcagtcgcccttgatcaaccagaattaagttaatcacgaccgtaatcccggtcaataggccaatccagccatgtaggctgtaatcgcgacccagaataaaaccaatgatggttacgattagcatcgtgctcatcatcaacttagtggtgcggcgaagcgtctttaattcattaagtccccgttgccagctgaagacggcgcgcatggccgtgggcagactagtgatgtcttgctggcattgttgcagcagggttgataaggtgagtcggaaatggttgttctggttcatagtgaaacactccttagttgtttttagacagccgtgttcggaagcaacgctgtgtttgattgctgtttacattagcttgttcaagcagacctgtcaacgagcttcgcacatattgaaggccgattattaatagattaatcaattggtttcagtattgataagcaatcaccttaatagagtggctcgtgatatttatttgttgatagtgaaagttgagctgaaagaagtgattaattacccacagtttcacaaatattggtatagtagaagagtaagcgggaatgtctgtttaatcctgcctagccgttaatcggttagtggttaatgatataaattataagtcagaggagcgttttacggatgaaaatcggattcattggtgccggtaacatgggccgcgcgattattgatgggtggttaaaacaacaagcggtcgtcccagcagatatttatattcacagtgcccatgctgcgagttatcaaccttatgcgcaaaaaaatgggctacaggcctgtgacactaatttggccgtggcacaagctgctgacgttatcgttttggcagttaagccgaacattgcgttggccgcattaaaagaagttcaagcagctttaacgggcaagtgggttattacaatggtatcaggattgagtttggccgattatgccacggttgtccctgatctccccgttctgagaatcatgccgaatgtgaacgtggcgattggtgccgggatgacggcgttggttggtaatgatgccttaacaccagagcaatatgcggctgggcaacaattattcgatgcgattggtgccacgagtgccatcgctgagaaagattttccaactttttcagccttagcaggtagttcgccggcctacatctatttctttattgacgcgatggcccgcgcaggcgtcaagcacggtttgagcaaggatgcagcgactaagattgcggcgcaggccacgctgggcagtgcgcagaatgttttagcttctgataaaattccgtttgacctgatcgatcaagtttcttcacctggtggcacgacggttgctggattactggccatggaagaggccggctttatgaccgcagtggtgaagggaattgatgcgacgattgcgaaggaacttggcgaatcttaaattacttggtgctggtggttgcaagtttggtctataccgattataattaaaccagataaatccaaggaggaattgttcatgagcaaagtgttaaaacatgccatcatttatactggtctagaaaagatcgatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagatcattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaggttgtcgggtggtcgggttaagttgattacttacgcgccggaagatcctggttcgcgtgaatttgaaaagtactgcttggaaaatggcattgtgccttcagtgggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaatattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataaattagaagtaagggatgagtaccatgagttcgccaatttatattcaaatccacaaccaaattaagcaggcgattgaagcaggtcggtgggccgttggtgaccggattccgtctgaacgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttggaagaaaaggcaagtttagtgcctggtaaggctcaacagacggtttcggcgatgtctgcttctgagcgtatcgcagaatacttgtcagtccggcgtggcgatgcgttgctacggttacggcagatttcgtatttgcaaaccggcgaaccgtttgaatacgtgcggacccagtacgttggtaaccggtttgagttttatcttgaaaaataaccagtcagtcgggtgctgggcacctgattagagtggtgataccaaaaatagctcacctaggatgttattctaggtgagctatttttggatttatgactgaagactgggtacacgcacaaaagcaattgtcatcgtaacgcagtggcttataactggtaatgattgccagttaatgggcttgctggcgcgctatttttttaactaaccgcaagtagcggggtaacacgagcatccgcttgaaacgacttggttcttgaatcagacggtagagccattcaacgtggtgtttttgccaaaataacggcgcccgcttaaccgcgcctgcaattacgtcgaagctacccccgacacccatccagagcgcatcgaggcgttggcggtgttcggcgatgaaaaattcctgcttaggaaaaccagtggctacgaagaccatatcgggttgcgcggccacgatttggtcgacaatggtttgttcgtcgtcataatagccatcacgggcacccgcgacaacgatgccgggataatctcgttgaacgatcgtggtcacttgctttaacacggccggcttggcacctaacaaaaagatccgttggtgctgttggctaccccattctagtagtgttaaaagggtgtcatagccggtgatccgttcggggagtggtgtgccaagaatctgggccccctgaatgacgccaatgccgtctggcgtgatatagtccgcttgtgttaacacctgttggtaatcggggtgttcacgagcgtacattaagatctcggggttagcggtcaccacaaagcgattgtgatgcgcgagaatatcggtttgaagttgctgaacaaaaccagcgttagttgtcttgataaacggcacgtttaagatgttaaccgtgtcaaaagggactgacataagcgacctcactttctaatcataattaaagtataggtaaatcaaggaattctgcaactttttggatgcttaagcgcattcttttataaaaaatgctaaaataagcttaacttactgtaaacacggttattacctacgaaatggagaattatactcatgacgcaaatctatccggatgatagttttaccttgcatacggatgcttatcaaattaatatgatccaaacctactgggaacaaggtattcacaacaaacatgcggtgtttgaagtgttctttcgtaagatgccgttccaaaatgggtacgcggtatttgcgggtctggaacgagttgttaattatatcaatcatttacattttacggcaactgacatcgcgtatttacgtgaactgggtggctactcagacggttttctagattatttagcgaatttcaaatttgatgcgacgattcgtgcggttcgtgaaggggacttggtctttaataatgaaccgttgttacaagtcgaaggaccactggccacttgtcagttaattgaaacggcactactcaatattatcaattatcaaacgctgattgcgactaaagcggcgcgcattaaatcggttgtcggtgaagatggcttactagaattcggtactcggcgggcgcaggagtttgatgcggccatctggggaacccgggcggcttatattggtggctttgacgcgacgagtaacgtgcgggctggcaaaatttttggtattccgattagcgggacccatgcgcatgcgctcgtgcagacttatcgaaacgattatcaagctttcaaggcctatgcggagacccatcatgactgtgtctttctagtggatacgtatgatacgttacgtagcggggtgccgagtgcgattcgagtggctaaggaaatgggtgataaaatcaatttccaaggggttcgtatcgatagtggcgatatggcttacttatcaaaacgcgtgcgtgaacagctagacgaagctggttttccggatgccaagatttatgcgtcaaatgatttggacgaaaaaacgatccaaaacttgaagatgcaaggtgcaaaaattagtgtctggggtgttgggacgaagctaatcacggcctttgaccaacccgcgttaggggccgtatacaagatggtttcgatcgagaatgatcatcatcagatggttgatacgatcaaactttcaaataacgcggaaaaggtctcaacgcctggtcaaaaacaagtttggcggattacgaagcgtgcggatggcaagtcggaaggtgactatgtgacgttgtacgatgaagatccgcgcaacgaagaatcaatttacatgttccatccaagctatacgtatattaataagacggtcagtgactttgatgcgcgaccactattggttcccatctatgaccgcggtcaacaagtttatactttaccaacgttagatgaaatcaaggagtattcatttgaaagtctagatgcactttgggacgaatacaaacgggatttaaaccctcaggattacccggtcgacttgtcacaaaaactttatgatcataaaatgaatattattaacacggtcagagaccacgttaaccataaagatgaggaggaagcttactaatgcggccattacaagctgagattattaaagcgttacacgttgcaccaacgattgatccagaagttgagattcgtcgaagtattgattttttgaaggcttatttaactaaaaatacctttttgaagacctatgtgcttggcatctctggcggtcaagattccacgttagctggaaaattgacggagatggccattaccgaaatgcggcaggaaacgggtgatgatcgctatcaattcatcgcagtccggttaccatatggcaatcaagcggatgaagcggatgcgatggcagcgattgattttatgcaagccgacgtgacggatcgggtggatattcaaccggctacggatgccatggtaactgcattggaagctaaccaattgacgattcatgatttcaacaagggcaatattaaagcgcgccaacgcatgatcgtgcaatatgggattgccggtgaaatgcacggtgctgtcgtgggaaccgaccatgcagccgaagctgttactggtttttataccaagtacggtgacggtggtgcggatattgtgccactatggcgattgaacaagcgtcaaggtaaacaaatgctggccgctttagatgcgcccaagcatttgtatgacaaagtcccgaccgctgacttggaagaagatcggccagcattacctgatgaagtcgcgttaggtgttcgttacgacgacatcgacgattacttggaaggccggacggtcagcgatgctgcggccgaaaagattgaggcgtggtacttaaagactgcccacaaacgccacgcggccatcactgtgtttgatgatttttggaaataagctagttagctgataatcgatcaggattacggctaacctaattaaaaaggcgacttgaagattattcagcttcaggtcgcctttttgcatagtcacataattttatggtgactaccgtaatattggtgggattggtggaaaagcggtagaatggtttaaaatatgtaaacgcttaatgtgagaatatccaagtgctgtggcgaatgcagaggtagtcaaagcgattattttgctagacagctcccatggaatctggtattcttacgatacaatcataagggagtaactagcagaaatattctgcggcaatatcgtcagcaagaagccaatccggtattgtcttaaatagtgagacttatgtatgttcacacaattttgcgtgcatacatgagtctcattttctatctggaaatcagttagggagtggggctcggatgccagaaaaggagcttacgatgagtacaaaaccaaagtatcaacaagcgttatccgccgtttatgaggaactaggcactgatgaacacggcttacagcaaagtgctgcgacgcaacggttagaacaatatgggccgaatgcgttgaatcagcaaaaagcgacttccttgttgcaaaaatttattgcgcagttcaaggatttcatgattatcgtcctgttagtggccgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcctggggatgttgtgtcgctagaagccggggatatcgttcccgcggatttacgattaattgagagtgcgtcattgaaggttgaagaatcggcgctgacgggtgaatctgtcccagttgagaagcaggcggagatgattgccgatggggaattaccaatcggggaccggttaaacatggcgtacatgaatagtaacgtgacgtatggtcgggccactgggattgtggtggcgactgggatgcagactgaagtaggtcgaattgccggcatgattgaagcggccgatgagacgaccacaccactgcaagcgaacttgacacagttaggtaagtcgctgacgattttaatcttagttattgccgcagtggtatttggtatcggaatgttgcgcggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttggtcgtcaaccaggaactggtggacgcgcgcgctactgaattgccgcttgatagccatttagcgcaagtgatgattttaagtaatgatacgaagatcatgccggatgggttagcaggtgacccaacggaaacagcgttgattcaatataatttggatcagggttatccagtcgatcagttgttgacggaccgtccccgagtgacagaagtcccctttgattcggaacgtaaattgatgtcgacggtgcaccccttagaagatggtcgcttcttagtagccgtcaagggggctcctgatgaattacttaaacgggtcactcagattgaaagtaacggtgacgttcagccgttaaccaagacaagccgtgaccagattctaactgttaatcatgaattggcaacgcaagccttacgggtcttagcatttgcttataaagtgatcaccacggttccaacgactgttaatacggagacgttagaaaatgacctggtctttgccgggatggtcggcatgattgatccagaacggccagaagttgaacaagccgttgcagaagctaaatcagctggaattcggccgttgatgatcacgggtgaccaccgtgataccgccgaagcaattgccgtccgtcttggtatcattaacgctggcgaagatgacgctgtgattactggtgccgagttagatgcaatgagtgatgcggaattcggcaaaaaggtcggcgattactcggtgtatgcccgggtggcgcctgaacacaaagttcgaatcgtgaacgcatggcaaaaacgaggcaaagttgttgctatgactggtgatggggtcaacgatgcgcccgccttgaaggctgctgatatcggtattggtatgggaatcactgggacggaagtttccaagggggctagtgacatggtcttggctgatgataacttcgccacgatcgtggttgctgtcgaggaaggccgaaaagtgttcgccaatattcaaaaggcgattcagtaccttttgtcagcgaacttaggggaagtcttaaccttgttcgtgatgacgatgttgggctggcaaatcttggcaccagtgcatatcttatggattaatttagtgaccgataccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagttgttccacgcgtttaattctaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataacccatccattaggggtaaaataaggctaactaatttaaagaaaagagtttgtacatgaaaaaagcaacgattcaaacgtatatgccagtactgtctaaagttatcgaaagtactgaaaaaatgggggaagaattaaacccatcttttgaaaaactacgtcaggccattgataatgacgcagttgccaaaatggttccagctgaattcaatgatattcagatggaatttagcgatggtactgaacagtatcaacaaaatttggcacagttgaaaaaagttgcggtacccgcacggttaatggggcggcaccgtaatttgttagcagcatacgaagcctacacgaatgcgtgtgcggccatgacggctagcatgaacatcgacgatcaaacgattgatgtggctgcttttaatcaggctgaaacggatcaagagactgaaatgggccgcgtttcaaataacgtgcaacggatcatgaatacagtcatgtaggagcgctaatctgggtgattggatttagcacactaataaaacgctcggtaacgtttatgcgttgccgagcgttttattgttggttgcggggcagccaactgtgcggccgcgccgtgctcgtttagcctaatgggctgtttttttccagctcacaaccaatgtgtgaacagtatcggtaatggcttcgattggtagtgacagtcaacgacaattttcagatggtcattcggcgcggaaacttgggtaaaacgcgtataatataatgtaatgagattaaaagattgggtgaaataatggataatcagattttaacgttagttaatcaaacgctgacgaagtttaaaccgcaacagatcaaagcggttctcggactcatggacgaaggcaacaccgttccgtttatcgcacggtatcgaaaggaacgtaccggtaacttagatgaagttgaaattcgcgaaattaaagataactatgatcggcttgcgagtctagagagtcgtaaggcagatgtgatgaagttgatcgctgaacaagatcacttgacgccggctttaaagcaagccattgaaaaagctgacaagttgcaagatgtcgaagatttgtacttaccgtacaaacagaagcgacgtacgaaggcaacgattgcgaaagatgctggactggagccgttagcagcttggttattacgttttccggcaagtggtattcaggaacacgcggcgcagtttgtgaacgaagcgcaggacatcacagacgcgaataccgcgttagctggagctcacgaaatcttggctgaggcctttggtgataatgccggtttacgaaactgggtccggaattatacgcgtgaccggggcttactagtcgcaaaagtgaaacccaagggtaaagcagccgatgaacaaggtgtttaccaacagtattatgattttaatagtcccatcaagcagatggtaccgtaccgggtactggctatcaaccgtggggaagccgaaaaagtattgaaagtcagcattgatgttgatcgtgctggaattgaccggtattgtcattttcgttttattggtcagcaccacggcccagcgattgaactagtagaagctgcttatcaggatgcctacaaacgctttattggcccggccatcgaacgtgaacttcgcaacgaattgagtgcggctgccaatgaacaggccatcaaagtctttggcgataatttgtaccacttattaatgcaggcaccattaaaaggtcgcgtggtattagggttcgaccccgcttaccggacggggtgtaaattagccgtgatggatgcgaatggtaagttcttagataagcttgtgatttatccacacaaaccagccccaactgccaaacgggaagctgctgcgggtgagtttaaagcctttttagagaagtatcatgttgaaatgattgcgattggtaacgggacggcttcccgcgaatccgaggagtttgtggcacaggtattgaagactatgacccgaccggtttattatgtcatcgttaacgaagccggggcttccgtgtactctgctagtgctaaggcgcgtgctgaatttcctgagctacacgttgaacaacgtagtgcgatcagtatcggccggcgactacaagacccactggcagaattgatcaaaatcgatccgaagtcagtgggagtggggcaataccaacacgatgtgccccagaaggaattgacaacgcagctagatacggtgattgagaccgcggttaaccaagttggggtcaatttgaataccgctagttcggagctattgacgcatatttcggggctatccagcacgattgcccaaaatgtgattacttatcgggatgaaaatggcgaattcacgagccgaccacaattgaaaaaagtgccgcggttgggaccgaaagcttatgaacaagcggtcggcttcctgcgaatcattgacggcaagaatgtttttgataacacggatattcatccagaaagttatcccgcagccaaagcgttattggcagcggctggattgaagacgacggacgttgggacgactaaagcccaacagttgaatcaattagatttagcgcaacttgcgaccagcaccggtgtcggtgaactgaccttaaaggatattattagtagtttgcaaaagcccgggcgtgatgttcgtgatacgatgcccgcaccgttactccggcaagacgttttaaagatgagtgatctaaaaccagggatgcagttgcaaggaaccgtacgcaacgtggtcgactttggggcgtttgtggatattggtgtcaagcaagatggcctcgtacatgtctccaaactaacggataagttcttgaaagatccgcgtcaggcggtggcagttggcgacatcgtaacggtgtgggtcgaagaagttgatgaacagcggcagcgcatcgctttgacgatgattgcaccggctgaagcataatgactgatttagagttacagcagctcgttgcgaccatttccatgcatgattttcaccgtccgttccagcaccgcgcttattttaatgctcggttacgaacgacgggtggtcgttatcagttggcctcgcatgatattgatatcaatccgaagatgctgactgattttgatgaggccaccttgattggcgtcatcaagcatgaattgtgccattatcatttacatttgactaagcggggatatcggcatcgtgatgcagactttaaacgattactcgcgcaagtgggtggctcgcgctatgcaccagcgccgaagcaggcgacggcccggccgtatcggtatatttatgaatgccaacggtgtggccggcggtattaccgcaagcgccgcatggacactcgccgctatacgtgtggtcgttgtcaggggccaattaaattagtctgaaaaggtttgctaaagtggtacgcttccgatagaattagcttaactattgatatggagggattaagatggaaacgattaaaattggtgtggtcggactaggcacagtcgggaccggcgttgtaaaaatgcttcaagcgcatcaggaaaagatttcagaaattaccggtcgtaagttggaactagcctgcgtagttgtccacaacttgaaaaagcacgaacaagttgatttgggggacgttcagatgaccgaccaaatcgcgaccctgcttgatgatccgtccattcaaattatggtcgaagtgatgggttcaattcatccggcgaaggaatatattacgcaagccttgcaagctggcaaacacgtggtgacggccaataaggacttgattgcgcaatatggccgggagttggttcagattgctcgtgaaaatcatcgcgacttattctatgaagctagtgttgctggtgggattccaattttacggacgattgataatagtttcgccgctgaccggattcaacgggtcatgggaatcgtcaacgggaccactaattacatcatgacgcagatgctgactaagcattggtcgtatgatcaagccttgagctcagcacaagacttggggtttgccgaaagtgatcccactaatgatgtcgaaggccttgatgcggcgttcaagatgattattttaacgcagtttgcctttgggatgagtctttccctcgaccacgttcaagttcagggaattacgaaaatcagcccagaggatattgcggaagctcatcagcttgggtatacgattaaattactcgggattgcggaagaaattgacgatcgcattgcggtatcagtcgggcctgtgctcgtttctgatcaacatccacttgccacggtacaaaatgagaataatgctgtaatggtaacgggaacggctgtggggaacacgatgttttacggtcccggcgctggagaactcccgaccgccaacagtgtgctgagtgatattacaacggttgcgaaaaatattgcgttgaatacgactggtaacacgtttaactcttatcgccaggagacagtcttagcaacgcctgaagatgttgtgtatcctcactttattgccttgaagatgcgtgatgtgccggggatgatgatgaaattgacggcgattatgacccgcgcagaagtttcatttagtcgaatcattcaaaatcaattaggtgacggcaacgctcgtgttgtgatcattacccatgccatgaatgatcaacagttagcagatatcactcgtgaaatcggtgaacaagagaatatgcaactattagcgagttataaagttttaaagaatgcgtaggtgaggacatgttaacgatttcggttccggcgacttccgctaatcttggtcccggttttgattcaatcggtctggcgctggacatgcaactaacgctacaagtgttgcaacctagtgaccattggcagattgaccatccctttggggcggatgtgccgacggatgaacgcaacttaattattaaaacggcgttgcatttggtaccagatttacaaccacagcatttacagatggcttcaaaaatcccgttagcgcgcggattgggtagtagctcgacggccatcgtagccggcttagtgctggcaaacgaattgaccggcgcaacgcgctcttctgctgagctactggaagttgccactcaactggagggtcatccagataacgttgcaccagccctattaggaggcttggttgtggcgacgaacactgatggacgcgtccgtgcggtgaagttaccgttaccgatgctttttgcaagtgtctacgtgcctaacgaaccgctattgacgaccgccagtcgccaagccttgccaactgaattggcgtaccaccaagccgttactggtagtagtgtggcaaatacgttagtggctgctctagcaactcaaaattgggacgtggcgttaccgctgctagaacaggaccagttccatgaacagtatcgggctaagttagtgccggcactacaaacggttagagaccatgcccatgctctgggattaacggggacttatttgagtggtgctgggccgacggtgattactttgggtgattacggtcaactcgctacgttgcaggcacaattgagccaagatacaacactcaccggccaattattcttattgccaatggatgcaactggtgtaaaagtacaaaaatcttaaaataagcttgtcagactcgcaaaattttgttatgatattttttgtgagttgtgatgcggccatggcggaattggcagacgcgcaagattaaggatcttgtcggggttaacccggtggaagttcgaatcttcttggccgcactaacgaatataagaatcgatttcgataggttaagccttgaaggatcgattctttttttgttgcggtaaattggactggtcacgttattccaggcttgcttttttgccaactacttcaactatgttcaccaaatttgccgtaccttattgtttaatctcatgattaccagcattataatgaaaacggttaatctactgattacgatattaagagaaggcgaggaccaggcattgattagaatgagtagatggtggtggcgtatcttggtgggcggcttgctggttagtggcgtggtttaccccgcacaagcggccgtaacgacttatccgattacagggattcaggtggtgcagccgcgggtctatcagacgaatagtcagaacggtgtcggttaccatttaaccgtcgtgcgtcatcagcgtgcccaattgcgtgttaatttacatttaaagtatcaccagcatacacagtggacgcgtactgagcaagctgatatttatcgcaacgggcattaccaacgcttctactatgtgcataatggtcatcagcagagcggctggatagctgctaatcagctaaaacccgccagtacggcgtcggttcaactgcgggtaccactgattgaccagctaccggagttgccaacggggtgtgagatgacagcgactaccatgatgctgcagtatgccggcgttaatattaataaggaacagtttgccagccacgtgccgcgcagttcgaatcctaacactggctttgttggcgatcctgcttcggcctatggtattggtctctacatctacccccaaggcttgttaccaacgatccgccactatctgccgtccgctgtagatctcagtggggtgggcctgcaacgaattaaagtgcagctcgctaaacgtcatccggtagtcgcttgggttcagggactcgatggttttgcgagtcatacagtgacgctcactggatatacagcggcaactattaggtacaatgatccttggcgtggtcaatccggacagatggataaccaagcgtttgagacgatgtggcaattaaatggtcgtcgggcactgagctattaagaaattgataccatagttaacattagttactgtttcataattttatattaaaaatacgctatttgacacacaaaataatcgtttttaatactgtatcgcactagtgtatcaacttctagcctgaaataagggcttttagctttagtgtattttggcacggaatttgcatatatataagtgagtgcgaaaaagattgcgcttacagtatcaaaaacataaatagttacaggcaatttagatattatttattcgttttatatgactgtaacgaaaaaataggaggtacaaagatggtaagcattatcattgctagtcacggcgaattcgctaaaggcatctatcaatctggatcaatgattttcggcgaacaagaaaacgttcaagccgttacgttgatgcctagcgaaggccctgacgacatcaaggctaagttggaaaaagccattgcttcattcgacgatcaagagcaagtcttattcttagtcgacctttggggcggtacaccattcaatcaagttaacggcttgtttgaagcacacaaggacaaatgggcaatcgttgccggtttgaacttgccaatgttaattgaagcgtatgcttcacgactttcaatggattcggcacacgaaattgccacgcatatcattgaaactgctaaggatggcgtaaaggttcgtcctgaagcattagcacctaaggaagaaaaggctgctgccgctgcaacgaccaacaataacgctggccggccagggaagttggaatatgggttagcacggattgactcgcgactcttgcatggacaagttgctactgcttggagtaagacagttaacccaactcggatcattgttgcgtctgataacgttgctaaagacgaactgcggactaacatgatcaagcaagcagcgccatctggtgtcaaagcgcacgttattccaattgctcaaatgattaagattgctaaagatgacaagcactttggtggtcaaaaggcgttggtcttattcgaaacaccacaagatgcattacgtgcaatcgagggtggtgtgccaattaagacattgaatattggttcgatggctcattcggctggtaaagttcaaccaaacaaggttttggcatttgatcaagatgatatcgacacttaccgtaaacttgaaaaagacggcatcgaatttgatgttcggaaggttccaagtgatggtaaagaaaatatggataacattttgaacaaagctgaaaatatgttgaaggaacaaaagtagttccaagaatatcagaaaagatggaggattaaatcatgaatttgaacgtaattcaagtgattttagtcgtacttgtatcatttttagctggtatggaaggtattttggatgaattccacttccatcaaccagttgttgcatgtaccctaatcggattagtaaccggacaattagtcccatgtattatcttaggtgggagtttacaaatgattgccttaggttgggccaacattggtgccgccgttgcacctgatgctgcgttagcatcaattgcatctgcaattattttagttttaggtggtcaaggccgtgccggagttacttcagctattgcgattgccgttcctttagccgttgctgggttactcttaacgatcatcgctcgtacgttagcaactgggattgtccacatcatggaccgtgccgctgaagaaggtagttttagtaaaattgacttctggcaatgggttgcgatctgcatgcaaggacttcgtattgcgattccagccgctttgattttggccgttggtgctacgccagtgaaggcaatgttaaacgctatgcctagctggttaactgatggtttatcaatcggtggtggtatggttgttgccgttggttatgcaatggttatcaacatgatggcttctcgtgaagtttggccattctttgctttaggttttgttttagctgcgatcagtgaaattactttgattggtttaggtgcaattggtatttccttagccttaatgtacttggcactttcaaagcaaggtaactctggcaatggtggtggctccaacacgggtgatccggttggcgacattatcgacaagtattagagaaggaggcaaactgagatgtctgaaactacaaatattactaaaaaagttacattaagtaaaagtgatcgtctgcatgtttggtggcgttcaacgttcctccaaggttcatggaactacgaacgtatgcaaaacggtggttgggcttattctttaattccagcaatcaagaaattatatacaactaaagaagaccgtgctgctgctttgaagcgtcacatggaattcttcaatacccatccatacgtggcttcaccagttattggtgttaccttagcgcttgaagaagaacgtgccaatggggcacctattgatgacgttacgattcaaggggttaaagttggtatgatgggacctttagccggtgttggggacccagtgttctggtacacggttaagcctatcgttggtgccttagctgcatcattggctatttctggtagcattgttggaccaattttgtacttcgttgtttggaatgcaattcgtatgggcttcatgtggtatacccaagaattcggttacaaagccggttctaagattactgatgacttatctggtggtattttacaagatattacccgtggtgcttccatgctagggatgtttatcttggcggcgttaatcgaacggtgggttgttgttgacttcagtccagttaaagtttcgaccattaagcaacaagctggttcgtacattgactgggataaactgccaaagggtgcttctggtgttaaggaagctttaacacaacaagctgctggccgttcacttgacaaatacaaggtaaccaccttacaagataacttgaatcaattgattcctggtttgatggcgttgctgttaaccttcctctgcatgtggttattaaagaagaaagtttcaccaatcattatcattcttggcctcttcgtatttggggttctaatgcacgttattggttggatgtaatacttgcttatgtcatatttaaaggatggactcgtgggagctcatcctttttatttacaagcgtactttgcataactgacaaactcgccgtataatcggtatgaggatggatacgaggagggattaatatggtgcaatcaatcaatactaaggttgatttagttacgaacggtaattcacatatgggattgaccgattacggtaaaattatggtcggtgataacggctttgaattttatgatgatcgcaatgttcgtaattttattcaaatcccttggactgaagtgaaatatgtggtcgtatccgtaatgtttggtggccgttggattccacggttctcttttcaaacgaaacggaacggtatgattactttctcagctaaggaccctaagaaagtgttacgagccgttcggcaatatattgagcctgatcgaattgtaaaatcactgacatttttccaagtccttgggagaatattcaagggtaaaggtaaaaaagataagtatttgaaataatgaccaatgctgtcgagggttctttgccgacggattggtgattatttaatagttagtttaagaagcttaggtatcaacgggtggggttagcgcgttgcagtgtctaagctttttttgacgcatcaaaagcagtatctgagcacgttaaggtgcgtcataaatggaatttcaataccatgaaacagaaatagttgtactgacaagtcttaaaaagtaattgagtcgggaactatggtagaatatagtgtgttatagtgtatcaaaacggatcagctatttgatagtggtgaaaaggagtggcgaagttgaccagaaaatccaagatttgtgaatacgtccgtcaacatagcgatcgacacggactgacgacggaaatggtagcgaccgctttaatgatagcgcgttcaaacgtcagcaaggaattaaatgcactggtgcgagaaggccagttgcacaagctgacagggcggcctgtgcactatgttccggtgaatgcaacagccacaacggccacaacaactagtggcgtagcgaatggagcgacgacagagcgaataccgacagcgcccgtcgcgacgtctgtgcctaaaccggttgtaaatgatatatttgccagcatgattggctcgcatgagagccttgctaatcaagtggaacaggcgaaagcggccattctttacccaccgcggggattaaatacattaatcattggcccgactggttctggtaaaacttactttgcaaacgccatgtatcgttttgcggaaacccaacaagtcttaacgaacccgcaaggcctgattacgttcaattgtgccgattatgcgcataatccggaattattgatgtcgcatttgtttggttatgttaagggggcttttacaggtgctaatgaagataaggacggtttgatccaagaagcggatgggggcatgttgtttctagatgaagtgcaccgtctaccaccagaaggtcaggaaatgattttttatttcatggatcacgggacttattcacgactcggtgagacggcgaagagtcaccatgccaatgtacgcttagtttgtgcaacgaccgaggacccagaaagtaccctactgcagacctttgttcggcgaattccgattacgattcagctaccagcgttcaatcatcgctcagccaaggaacgtttagaattactgaaggcattattgtcattggaagctaatcgaatcaataaacagattcggttaacggaggacgtggtgcaggccttacttggctcagtcacatttgggaacgtcggtcagttgaagtcgaacattcagctggtgtgtgcccagggttttgtcaatagcatcgaaaatgacagtgaaatcacaatcacgatggatgatttgccacaaaatatccgtagcggtctcatgacagtagcctctaaccgtcacgaactgggggccatctctgagttgttggacccggttctcatcgtgaagccaaatgatggtccaacgccgcttcgtaataagaacgataattatgaattaccatataatttatatgagattattggtgataaagcagcgttactccgacgggaaggccttgataaagaacacatcaatcgtttcatcacgaccgatatcaatgtgcatttaaaatcattttataaacaaaatcagttagaagtttcaccagaaaacaagttagccgagatcgttgatcaggacgtcattgattttaccaagacggcgcagatgacggttcaagacatgctaggttataatttcaaggataactttatttacgctgtgagcttgcacgtcagttcctttatcaaacgcatccaggcaggcaagcccatgcgtcaaatgagttcggatatgttagcgatggtgcgtgaatatccggctgaaatcaaagcagcggaggcgctcaagcaaggattagaggaacggtatcatttaccgattcccaagtccgaagtttattatctggccattttgctcatctcgttaaaatcgatgcagcttaacggcaaagttggcgtgttggtggcagcgcacgggatgagtaccgcgtcttccatggcacaggtcgtcggacaattgttagatgattatgatgttcaggctttcgacatgcctctcgatatggacccgagtgtcgcctatgatcatgtcaagcgacgagtagaaaagcttgattctgggaaaggaattttgttactagtcgatatggggtcgttaacgaccttcggggaacgaattcagcaggagacaggaattgcgacgcgaacgattgacatggtgaccacgccggttgttttggaagccgttcggaaggctagcctggtcgatagtgatctggattctatgtatcaggagctcgttggtttcaaaggttattcgcgaatttcacggaacctaccaacggatagtcagcgcgcaacagtcaagcccgccttagcgacggataagacggcacaacgggcgattattgcaatttgtgcgaccggcgttgggacggctgaacgtatcaagtcaattttagacagtttattagctcaaaactttatcgaaggtattacggtattcccaatctcagtggtcgaaatgaagacacggatacaacaaatcagtcaaaattatcaaatcattgcggcaactgggattacaaaacccgaattagacgtcccttttatttcattggaagaattgctacaaggtggtggcgaaaagtttattgaccagttagcgacgggtatcgattcgccacagaccatggcggaagaaagtcagcagttgacaccggaactctgcgaacggtacttaggcgattacttcacgtttttaaatcctaagaagttaacgggaattttatgggagtatagcgaagtgattgcgacgcacttggatggtgtaatgacgaatgcttttcgcattgatttgattatgcacttagcgggtgcgctagaacgaacggccatcaaagatgaaatttcggcacccaccgaagagatgccagacattatggcatcgaagtggtacccacttgtgcaacaggccaatcagcaattgacagatcaactacagttaaccttctcagatgctgaaaattattatattgtgcaattattggagactcatcaggcaaaggtcgcgatgagttgatacactaacttggcatgctttttgcatgtatcttattgagtagatttaaccgactgaggagggaaagtagatgttagcatttgtcgttgtcagtcatgggagttttgcgcagggcgttgtcgattcatcctacatgatctttggcaagcaagataaggtccaaacggttacctttcaactggacgaagaacctaatgaattagctgataaattagctgctgcggttgcccggtttgacgcggatgaccaagtcttattcttggttgacctatggggcggttcgccatttaacgccgctagtcggatcgttgccgaacatacagagcgcatgggtctgattaccggtctgaatctgccaatgctgattgaggcttacactgttcgtgataagccaattgatgaggtgattgcccaccttgaagagactggaaagattgggattaagcatctcaagttgttacaggacgatggggaagatgagccgctatgacgatggatattcgtttagcacgcattgatagtcggctactccacgggcaagttgccacggtgtggaccaagacggtcagtcctaaccgtattttggtcgtctcagacgaagttgcccaggatgcacttcgcaagattctaattgtgcaagccgcgccccctggtgtgaaagctaatgtgattacagttgacaaaatgatcgagatttatcaagactcgctatttgatgaagtaaagccactaatcctaactgatacgccccagaacatggcgcgcttagtagcggggggacttgattttagcaaaacgggcattgatattggtagtctagctttttcagcgggcatggtgatggtcaccaatgctattgcaatcggtcaagccgaagcacgggcattatatgcgttacaagcagcgggattaaaggtgtttgcgcagaaagtcccgacggataaacgggttgatgtgatgccgctattatctaaaaatggctttatggcgccagataagtattaacaaagttatgatggacagtggtgtgtcggttatgggcaccactgttctttcattttggctaggtttctaaggatttaccaaaaatacagccgtaaactttgacggataggcttttattgataaaattaaactaatcgaaacggaaagtagcgggggtttaaaaatgccaacttatacaaaattaaccgccatgggacaatatgttccgggacgcgttgttgataatgacgaattagcagccattatggacactagcgacgaatggattcaggcgcatactgggattaaaacccgacactacgcgatgaatgatgaaaacacctcggatttagccacccaggtcgcccagcagttactacaaaaaagtggtttagctgccagtgccattgatttgatcctagttacgacaattacgcccgatgccttaacacctgcgacggcttgtttagtgcaagctaatattggcgctgataatgcgtttgcgttcgacctgagtgcagcgtgtgctgggttcacgtttggcctagcaacggctgacaagtttattcgcagtgggcaataccaaaatgtgatggtgatcagtgcggaagttaattccaagatgatggactttcaggaccggacggcagccgtcttctttggggacggtgctggtggcgcgttattacaagctactgacaatccagatgaaaacagcttgatcgctgagaaattagaatcgcaaggaaacgctacggtcattcactctggacgagtacggccgattactgaagttgccgcaacgaactacccgcaaacggatgcgttttaccaagttggacgggatgtttttcaatttgccacgacggttgttccagaacagatgcgtgggttaattgcgagtgcgcaactgacacccagtgatttacaatacgtgatctgtcatcaagctaatttacggatcattgaaaaaattgcggctaacttggcgttaccaatgacgaagtttccacataatgttgatcattatggtaatacgtcctcagctggggtggcaatggccttagccaatgtttttgataccttaactgggccagtgttgttaacagcatttggtggcgggctagcgtatggctcagtcttgatcaagaagtaggggtgtgcagatggaattaaaagatttagatcgattagttgagaaatacgcgcgacagggttatcagcaaattcgcgttaaagccggcgacttggagattgaagtgacaaaaccagcgttagcttcagaaacggtaactcccgtagccgctacgcctgccagcacagttgcggagactgaagatgaagtcgttacactgccgagtccgatggtcggggtggtccacttggcaccagatttaaaggttggtcagtcactgacagctggtcaagaactaggccagattgagagtatgaaattattcaatccattagttagtccgaccgatgggacgttaacagcagtactagttgctgacgacgccactgttgagtacgaacaaccgttatttacaatgcgaaaggatcggtagctatgtttcgcaagctgttaatcgcgaatcgcggtgaaattgccgtacggattatcaaagcctgtcaacaattgaatattcagacggtcgccgtttgctcaactgctgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgcgctaaggattttgcacggcaacaagccgttccggtactagcaggtcaatcattacaaggcttggcatggccggatattaaacacgcggccgccaagatcggttttccactagttttgaaagccagttatggtggcggtggcaagggtattcgagtgcttaccgacgttcatgaactccatcaacaattgcgggctgcgcgtcaagaagctgctgcgtcctttttgaatgatgcgatgtatttagagcaatttctgacaactgcccgccatattgaagttcaagtcctcggcacggggacgaaattattcattcttggtgatcgtgactgtagcctccaattgcacaagcaaaaggttctcgaagaaagtccggcaagtattttgactgagacacaacgccggaccttatacgatttgtcccggcagttattagcgggtacacattatcaaagcttgggcacaattgaatacttatttgcggatggtcagttctatttcatggaaatgaatacgcgtttacaggttgaacacggggtgacagaattaaccaccggaattgatattgtggctgaacaaatcaaacaggcggctggcgtcacggttgattttccagagcatgttggcttgcagcccaagtgtacggcgatcgaagctcgattgaccgctaccttaccggttaagcagacgcggattgaaacgctgagctggccagccgatgtacgagtggatacggattatcatcagggcgatcggctagtaaccatgtatgatggtttaattgccaagttgatggtcaccggtgtgaaccgtcagcaagccgtgcgcaacttacaacgggccttagcgcaagtaacattgacgggacccacgacgaacttaacttttctacagcaaacggtggcccggccggcctacattcatgatcagtacacgattcacagtctagcacgttgggaggcgtcgaaatgagtcattatccagcttctgggacctggcaagcctgccctaagtgcggtcggcacgtccaccaacgccaatggggcacttatcagcaatgtccttattgtcactattggcaacgactgacgacggcgcaacgattagaacaactcgtcgacgaagggtcgtttcagccgttgacgatgactgagcggcctgtcaatcagctggggttcccggactatacgaacaaactgcggcgggcccaacgccagaccggattaaacgaggctgttgtctgtggaacggccttgattgagcaacaaccctgtatcttagcagtgatggatagtcattttatgatggggacgttaaacacggcggtcacacgtcgcttattgcatgctagtgaacaagcgcgggcccaacggttaccactgatcattgtgaccgcctcaggtggtgctcggatgcaagaaggtgtttatgccttggtcggaatgaatttgattctggcagaattagcacggttagcagcaacgccgttacccttgatcacagtgctgacagatcccactatggggggcgtatcggcgagttttgcgtttaagggtgacctgattatcgcagaagcgggtgctaagattggctttgccggagcccgggtcatccaacaaactttgcctgtcaaactgccggcggattttcaaacggcggatcagctgtttaaaaatggtatggtggatgcagttgttgaacgacctcaattgcggtcaacgctaggacaagcattagtgaattatggaattgggaggtcagcccatggataaacgattacagcgattacgggcggctgatcggatcagtgcgccgactatcattcaagcgttattgccgacaatgacgcaacaacggggtgaccgcttattaggtcaggatgcggctttaacggcgggctttgggcgcactgccactggtcgccaattagctgttctgggcgttgaccggggtgttgatattgcgagccggcgtcgaaaaaacgggggagcattaactgttcccggctatcgcacggcgttaagagtcgtaacccatgcggctaaatttgggtggccggtcgttagcttaatcaatatgccaggtgctgatgcgagcccccaatcggaacgctatggtcagagtcaggccattgcggacttgattgcggcgactggtcagctgaccgtaccgaacgttgttgtatttctcggtgagggccatagcggtggggcgttagcctttgccaacgccaaccgcattatcatgctagatgatgcacttttcaacgttgcttctcccgaggcagtcaccgcgattttacatgggcaacagaccagcagtgacgccatcgatttattaccaatgacagctagcgctttgcagtcgcgcggcttagttgacctggttattgaccatcaggatcagacattagtcgctgcgatcaaccaggcgattgagacccaacttgccgcactagaagcattgccggcaccggatctaattgaacagcgcgaagcaaagtttcaacactttttacaatcttggccggtcaattaaaaataatcatcaaaaaatgggcttctcagaatttttattctgaagaaacccattttttaatagttgcttagtactgattagtcgtggtttgatcttgagtcgtggtctggtcctgcgtcgttgtatcttgtgtcgtactagtgccataagtagtggtatcactagacgttgtggtacttgatgaacttgaactggaacttgagctacccgttgtaattgaagctgtctcagagaagactgactctgttaaattactgtttgagagtcccagcgctttacggatgcgcttcgaattcttgtaacgttctgacgaagaggcaacttgataagagagcccatcgatcgtcgcgtcagtaccttgaacggtatatgatttggcatggtgagacgcattcttgtacttcgtatcgagtgcgaccatgtcattccaagttaagtcggtgcgcatgttcttagcgagttttttcgtaatcttttcaatattggcaattgacccaagtgagttagactgactaaccatggccataataacctgccgttgccgtttttgacgaccataatcaccctgaggatcgtcataacgcatccgtgagtaatcaagtgccgctgcaccattaagtttgatcttaacgcctttcttaacgttggcattaccgtatttgaaagtcagcttaggtgtcacggtcacgccgcccatcgcgttgatgatctgttttaaaccacccatgttcagtaagacgtagaagtcaattggaacatccagtaacttctctactgacttgacggcaccacttgcgcccccaatggtgtaggctgcgttaattttttgtgattgcccatcgatcatcacttgcgtatcccgtggaatactagtgagcgtcatactttcttttttaggattgattgtcgcaacaatcatggtatcagtccgggctgagaagtccttgccgcgacctagtgcaccagtatcagttcccaacagtagaatcgagaatggcttgcccttcttaataacggcatcaacattccgaagcttggtcgagccggtcgactggtaggtcgtattcatcgtatccttagcggcattccaggtcttgtagccccaccagccacccgtaacgatcaacaggacaacgacgattagtaaagtaattaaccaaggacgttttttgtgtggtttcaaatgtgggttacgctgttgctgttcacgatagcggcgttggcgtggtcccatttcattatcattgttattttctgacatattcgttcctcatcactttagatttttccctcaatagtcattttatgacgtttagcaaatcattggtccttaaagttagtaatttaaaaagattttaataatcaaaaaattactggcatcagtagtaacacaattatagaacactataagtaatattgtgaccggcgtcaaacgtttccatctataaattacggtacaagccatcataaaacagtggtatacttgaataattctcattgaattattattttacatagcttgatagcgatattcaatgatgagcaatttgttaagaggggaagactgagcgtgcaaattttacagacattcgtgcagagtattcaaggtgtcatgacgatcatcgtgatgattgcagttggttacttgttggcacgctggggctggtttaatgaaagtgcgactaagctgattgcccgattggtcactcaaattgcgctaccagcctatatgattgcaacgatcacaaagcagtttacagcgcataaattattatcaacgttgccaggattacgttttccagttcttaatatggctattttgtttggcatttcgttcggggtgatgcgagccttaaatattaaaaagagtcatcgcggcttatttgcctccatgtttttgaactccaatacggtgtttattgggctaccggttaatcaagccttgtttgggaacagcgcattgccatacgtgttagtttattacatggccaataccaccattttctggacgctgggcgtttatttgattcaacgtgacggtactggcaccgctaagtttgacttgaagcagacactgaccaagatcttctcaccgccattactaggatttatgattggtgtcttgcttgttctaggaaacattcacgttccaaaattcttgatggatgatttctcatatatcggcggtctaacgattccgctgtccatgatctttattgggatttcaatggccaacgccgggttaagcagcatgcgcttcgaccgggatagcttgggaattttacttgggcgttttatccttgcgccggtactgatgacgctgatgcttattccaatgtcgattccattggagatgaagcaagtcttcattctgcagtccgcgatgcccgtcatgacgaacgcaccagttgtctccaaactgtacggggcggatgccgattatgccgcggtcatggtgacagaaacgacactattgagcctaatcgttattccgattttgatggtgatcgttcaagccaactttattcgttaattattgtgtgacttaaaattaaaagtacccgaatgcgtgccactagtgacaggcgttgcgggtgcttttttgctggttgttaatgatgaaaactcaatttagttcggtcaacaaggtttgaccaattagatactttctgctcagggccgtcccaacacgtctcgctggtagtttttgatgacaagctgatgagtgcgtgctggatgatggttgaggcggcaagatgccattgaatggttcaagcctgatgaaaattgttttcaaaggcaattaaaaattgaaaaaaataacgcctgattccgcgttaaacggcgttttcccgtggataaaagcgaggtagtatactgagctgatttgaaagtcacgtgaaaatggtgctatactgagaaccgttgcgtattaaattttgattaagaaggaagcgaacgtttcgtgaagaaagcatatctttacattgcaatttcgaccttaatgtttagttcgatggaaattgcgctaaagatggccggcagtgcctttaacccaatccaattgaatctaattcgattttttattggggcaattgtgttactgccatttgcattgcgggcattaaagcaaaccggacgaaagttagtgagtgctgactggcggctatttgctttaaccgggctagtgtgtgtcattgtcagtatgtcgctttaccaactcgcgattacggtcgatcaagcttcgactgtggccgtattgtttagttgtaatccggtatttgcgctattattctcctatttaattctgcgagaacggttgggtcgagctaacttgatctccgtcgtgatttctgtgattgggttgttgatcattgttaatccggcccatttgacgaatgggctcgggctgctattagccatcgggtctgccgtgacttttgggctgtacagtatcatctcgcgttatgggtctgttaaacggggcttgaatgggctgacgatgacttgttttactttctttgctggtgcgtttgaacttctagttttagcttggattactaagattccggctgtcgccaatgggttgacggccatcggtttgcggcaatttgctgccattccggttttggtgaatgttaatctcaactatttctggttactattttttatcggcgtttgtgttactggtgggggcttcgcgttttatttcttggcaatggaacaaaccgatgtttcaacggcttccctagtattcttcattaagccggggttggcgccaatcttagcagcgttgatcctccatgaacaaattttgtggacgacagtggtcggaattgttgtgattttgattggttccgtcgtgacctttgtcggtaatcggttccgtgaacgggatacgatgggtgcgattgagcagccaacagcggccgccactgatgatgaacatgtcatcaaagccgcacacgccgtttcaaatcaagaaaattaattaatcgtggacggtcagggtgatattaatcagcttgaccgtttttttgtggcaagcgcgttatctcacgtaacagctggttgtgactttgaaaaatgaaccaaatcgattatcataggaagtattgaagatagtaggtgggaaagagaatgacagaactagtattggttcgccatggtgagagtacggccaatcgggataatacgtataccggttggagtgacgtcccgctaacagcagtgggtattgcacaggctcatcaagctggcaagcgattacgagctacgggactgcagtttggcgctgtacatacctcagtcctaaaacgggctatcgttaccgcgaatattatgttaagtgaaattgatcagttatggctgcctgagtataagacgtggcggttaaatgaacgacattacggtgccttacgtggtcaaaataaggatgtgactcgtcaagagtacggtaaggcgcaagttcaacagtggcggcggagcttttatacggtgccgccgttgttggcaccagctgaactagaccatgatcgacgttacaccaagtacggtgccgccgtcgaaccgcggggagaaagcttgaagatggcttacgaccgcatcatgccttattggatcgatgagattgcaccgcggttgttagacggccaaaaccaactcgtggtggcgcatggtagtacgttgcgtgcgatgatcaaatatttagagcatattagtgatactgggattgatggtgtcgaagttgctaacggagtgccaatttgttatcaccttgatcggcaactgcacgttatcggtaaagaagagtattaaatttagtaatagttctcttaagcggtacttttatttaaagtaagtgctaatctggactgcttttttagaccattatcagattaatcgagcctgagttaagagattcagcagacgctgaagctctttttttagttaaagtgttaaataaatgcccagtataagtaattataatcattgataataattgccgacgagtgctcaaaaaatgatacaggcttaaaaagttgatataacagtgctttcacaactgcttgagttaatataaatatttttaatgtaataaaatccttcagttttcataaataaatataatatataacttgtaatagaatggtgaacgctgtaacatatcagttggacaaagttgcgatttggcgcgcttgacagccaaaaatctgatcagaaagccgggtaacgttatgatgaaacataaaaatttattattattaattataatgagcttgggcttctgcgggatgctgttgatgtttgcgccacaaatcagtacgctgatcaacccgaatgcgtcgcgagttgaagcggataaggctagtggtcacgatacgacgcatgatcaggtctactacaatgatcagatggataactatcaatatgattatataaataacgggactaaggttttgaactataaggcccgttttaagagtcgggtcatcacgtatcggatcacgagtgacagcaaggtgtatcgagcgatttggctacgagccgtggaacgttggaataacactaacgcggtgaggttagttgaggctaaggaccaagcgaaagcccagattacgttgggcgagagtgaagacgagacggagacgaccggatcggaaatcggccggacttggcggacgtactatcaaagtggttcgcaaggaacaacttggatggattcggcgaagtgtgtgatttacacgaatcgctttccagccagcaatcattcggtagaatataagctgtccgttgcgacccatgaattgggacatgcactgggactagagcatgagaacaataagagtgcggtgatgtattaccagtcgcatcgagcagcacatatcacgactcgtgagattagtacgcttaagcagatgtataaataattataatagtgattgctataagtaaacgtaataataaaaaaatcgactaaactcacgcgagtttggtcgatttttttattgtttgttgttagtagttccttgagcggtagttaagtctaatgcagtccaaaaagcaccatcacgctaaagcagtgatggtgcttaatttagatggcccattaaacttaattaggctaatgcacccattggatcccaaggtgctaaaacagttggttcttcggcttgggctgcctttaagtcatcggacaagaattccttgttaacaacaacttggtagcagtattcgtccatccaagcatcgctcatgacgaagaagcccttagtcccaactttgtcgccccagctattttcaaccttccacttagttggttggccgtcaacgaggtcgacaccggtgataaccatggcgtgggtcatcagactttcgccgtaatcaagacgttcagccttcgacattgaaaggtcaacgtcgaataattcatctttactgtagacatcggtagccatgacccctttttggcggtcggaggattgaccaacatcacaaccaaaccagacactttggccagcttgtaattgcttgatggccaattgcttgaagtcggccatagacacgttcaaatgtttgacttcacggccacctaagacgttacctaacatttcaatcgtgtaggtatggttataaggcttgtcgtcggttggggcgttgatgattgaaacgtaatcgtccaaattccagccaacgtacttttcgaagaagctttgtggcgtcaagttttggtcgatgtggtattgtttcttatcatcacgatattcccagtcaaaatgtgaaacgggttcgccaaaggcataggctaacatgcgatagacttcatttaacattttttccttgcgttcttgaatcgcgtcgtcactagttccggcagccactagttcacgtaattcaacggcatctttacgtaactttaagttaagtgtgctgttgatttcagccgattttgaactgttgtaagtttcaggcatgacactcttaggcacgataccgtacttctgaataatggcaacgagcatatcccattggccaccatcttgttgtggcgtggtcatcaaccaagcaactttacggctgctagttggttggtcagcggttgccaacacgttttcatagaaatagttcgctttttcgaacttatcccagaaaaaggtgtagttttgtgatagttcgaaatgtttcaagttgaatttttcagctaatgaatgccgcatcgtgtttaaagcggcgaacatccagcaacgaccactttgcttttggttcgcaacgtcacctgtatccaaatcaatggaaaatactggtgtggtttggctcatcgcctgaatatcttgactgcttgctaagataccgttcttagtgacactacgttcgatgacttttgcttcgggacgttggtccaagtcggcttgaaagttagcaatttggttcatactgattgctttactcaaaagatcactctcctttaatctaattctaattgtatcggtttatgacgggtggggcaagccgggagtcgcacaaaactatggtcgtgcttcgataacctcgggaccattggcatgaccgacaatgacagtgttgaccatgtctaagaacaggccgtgttcaaccacaccaaccatgtgaattaaatcttcggctaaagcgtggggatccgtgattgggtcgatgtgtaaatcgatgataatattattagaatcggtccggacgagttcatcgttgactttacggaatactgggttatagccccgagcagccattttttcaaagacatgttggctgccgtaaggaatcacttcaacgggtaagccaaaggcacctaattgatggaccattttgctttcatcaacaatccacatgactttatcagaattgatggcaacgattttttcgaagagtaaggcggcgccaccacccttaacgccttggaaatcatcggcgatttcgtcggcaccgtcgatcgttaagtcgagatggtcgacttcgtcaacggatttcatcgggataccgagcgccttagcttgggcagcggttcggtcggaggttgagacgccgacaatgtttaaatgttcatttttgacccgttcacccagagcatcaaccatgaatttaacggttgagccggttccgaggccgacctgcatgccgtcttgaatgtattcaacggctttttgaccaacaagttgttttaactgatcctgattcataatatgaattactcctttgattgagaactagtgactaatacgtcggcagcttcagggtgccgatcaaagtaagccttagcgtaggtacacagtggctgaatacgtttgtgttcaactcgagcggcgtcaataacggctttggttaattggccggcaatgccctgatgaccaaaatcgtcacgaacaaaggtatgttcaatgacccaggtctgatcattattgatggcggggaaggtaatttcaccagccaacttgccgtgatcgtcattaaaataaaagcggtgtgcttcacgcgtgaattccattgatttcaccaccttgtaaagggttttatatctaccgtaattaaaccggtaattgcccgttttgtcaacgaaacttctataataaaagtatggtaaaatgtgaacactaaattaatgttgagaaagtaggaatttgaaatggcacggggatttgaaattgtaagtcaatacgcgcaggcggggttacacgtaccttaccgcaccaccaagcaagcagctggctatgacttcgaagcggcggaagattttacgttaccgtcaatttggaaaatgaactttatcaaagtactttggcaaatacatcatggtgaaacgagttctgcagccgatttggatgcggcggctaaagtccttaaaccatggcttgttccaacgggtattaaggcatttatgaatgatggtgaatacttactattagccaatcgttccagcaaccccttgaagcgtaacttgattctaccgaatgggattggcgtcattgacgccgactactataacaatcccaagaacgaaggtgcgattttcgtccaattaatcaacatggggattcgcgacgttcacattaaaaagggtgaacgcattgcccaagggatttttaccccttatctgactgttacggatgaaacgaatgtgacaacgacacgttctgggggcttcggttcgaccaataaataggaaataataaaaaatcggtaaagccaaggtgatttaaaggctttaatgattaataatggtaaaataaacttatacccatagcatgaaaatgacgatccagttaattgagtttgattgattatttaagtctgcatcgtactggctggttgtttagtaagaatcatggttaaaaggtgccaattagatagatttctgttcgtctgcaatgactatcctattccgacctccgggaagccgctcgaatggcaaataaacggccgcttaacttggtacaattggttgctgactactttgatacgaaaactttgagcgaaacatcagaatgtattctctactttgtcgaaacgttcaatgtattatgactggtaactcagaaatagtaagtcatcacaatatcattttcggcctgacagttgattgagaaaattaccgtttatgaaaaacaacgaccaattcatcaaaagttgagtacatcttcatcagctattcgaataccatcccgactggaaggtgtttctgacaatgcccagtactgcaagagtgtgaagtctcagtctgacccgaacacgtttcaccaatatggcataaaagcgtgaaaggccagtatttaagacgtgggcttcggctcaaatctgtgcccaccgcgttccggcaattggcagaaatgcctggaggtcggtgtaggacgaattaactaagcaagtttacgctaacccggactgtttccagcgggcctaagctggctgcttttaaatttaaaaaacggcacgttttaatcatgactcatgacagtgtggcgcggatgaagtaaatattttagaaatcccaatacccaacattaaattgatatgttggcggagaaatggagacgtgtgtacgtggcaaaagcaaaaactcagtttgtttgttctaactgtggttattcaacaccgcgatatttaggacggtgtccgaactgtggtgaatggaatacactaactgaagaacattttgatacaaaaccggaccgcaagtcgcgggtgagctttgcgggtaagtcggctaagccacaacgactcaaagaagtgtcgctgactaagacaccgcgtgtcaagactaagctgaaagagttcaaccgggtcttaggtggcggtgttgtgccaggttcactagttttgatcggtggtgatccaggtattggtaagtcaacgttactactgcaagtttcggggcaattggccgagacgggtggttctgtactatacgtgactggtgaagaaagtgcctcccaagtgaagatgcgggcggaccggctggctgttagcagtgaagacttttatctttatcctgagactgatatgtcgaatattcgttcaacgattgaatcgacgcatccagaatttgtggtcattgattcggtacaaacgatgcaagaacctgatatggactctgcgattggttcagtatcacaaatccgtgaaattacggctgaactactgcaaattgcgaagactaacggcattaccatttttattgtgggccatgtgactaagggtggtgccattgcggggcctaagatcttagaacatatggttgataccgttttgtactttgaaggtgatttacatcatacgtaccgcattttacgggcagtcaagaatcgattcgggtcaacgaatgaactgggaatatttgagatgcggacgggcggtttgtatgaagtggccaatccgtcagagatcttcttggaagaacgtctgaaggatgctacgggttccgccatcgttgtttcaatggaaggcacacgaccaatcttagtagaagttcaagcgctggtaacgccaacggtctttggtaatgcgaagcggaccgcaagtggcttggatcataatcgagtctccttgattatggcagtgttggaaaaacgggcgagtctaatgcttcagaaccaggacgcgtatttgaaagcggccggtggcgttaagttagatgaaccggcgattgacttagctattgcggtcagtgtggcttctagttatcgtgaccagcagactcgtccgagtgactgttttgttggtgaagtcggtttgactggtgagattcggcgggtcaaccggattgaatcacgagttggtgaggcggctaagctaggttttaaacgtatctttattcctaagaataatctgcaaggttgggatatcccaactggaatcgaagtaattggagttgccacgctaaaagaagcgctccaattagcattacaacaaccaaattattaaaaaggggctgatgccatgaagaagttaacggtgcgactagtatttattgtcgtcgggggtacgttaggactaacttacctgccgttcttgtggacgacaattttgtcgcaaccaaatgtgttattgaataacgtttttaccaactttttgttgggggcgctgattctatgggttttgtcattgttcttagccaatgccgctgtacgactggtggatcgagtcgaaaagaacttatccaagcaaaatccaatgacacttttatttggcagtatcggatttattattgggttattgatcgcggttctgatttcgcaattatttaatcgtagtccattattcctattgaacacggtcgtcccaattattttgatgttgttttttggttacattggtgcgcgagtcgggactacccggatcgacgagtggcggaaagttttcaacttccgccgtcgtgaaaaggaaacaagtccggagattactgatgctcagccagatcagaactatcatcattataagattctagataccaacatcttgattgacggccggatttacgacattgtcaagactggtttcttagaagggacactgttagtaccgaacttcgtcttgtatgaattacagtacattgcggattcagctgatagtattaaacgtgtgcggggtcgtcgcgggctagatattttaaataagctacaaaatgaaaatattatcccggttgaaatgtacgagggcgattttgaggatattccagaagttgatagtaaactcattcaattggctaaaaaagtcaacggtgtgatcgtgacgaatgactacaacttgaataaggtgattgagttccaaaacgtacaagttctcaatattaatcagttggctaagtcgttgaaaccacgggttattcctggtgaagagatgaatgtcatggtcgtcaaaaatggtagcgaacgccaacaaggggtcggttacttggacgatgggacgatggttgtcgtcgaagatgggaagttttacatcaatgaaaaggtggatgtcgttgtaacgagcgccttacaaacggatgctggtcgaatgatttttgcccgtttagcgcacgctaatcgcggaatcccggatcatgcggatggaaataataagcacaacaataatcatagtaataatcgaaataataatcgcgataatcggcactaggttaagcgattcaacggtagcaactcatttgatgggggctaccgtttttttgttcaatgatgactaatccaggacgtcgtaagggaggcggccgaatcgcaacaaaataggagggttaatgctcattatcaataaattgggatgttgttagtgtacgattagggtctgtttcgatatttttacaatgggttcagtctgaaaccttaatttttagcggtaaacatggtaaactggaaaagcaagtgaaagtcggaatattctggtcgatagaaaggttccggcgtaacatttaagatgaaaaaatacgaaagaggcgttaatcacattggcaaagagcaagattcgtgtgcgttacgcaccaagtccaactggccatttacacattggtaatgctcggactgcattgtttaactatttatttgcccggcataataagggaaagttcattcttcggattgaagacaccgatttaaagcggaatgttaaagacggtgaaaagagtcagatggacaatttgacgtggttagggattgattgggacgaaggtccggataagggtggcgactttggcccttaccgtcaatcagaacggaaatcaatctatgacccgttgattcaacaattaattgatgaaggtaaagcttacgaatcttacatgacggaagacgaattgtcggcacaacgtgaagctcaaaaagcgcgtaaggaaatgccacactacgtctacgaatttgctggcatgacggaagacgaaaaacaggcgaagatcgcggctgctaaggcggctggtatccaacccgttattcgcttccacgtcccagaaaatacgacctatgcttgggatgacatggttaaaggtaaagtttcgtttgaatccaagacggttggtggcgactttgtcatcaagaagcgtgacgggatgccaacgtacaactttgcggtggttgttgatgaccatatgatggaaattagccacgtcttccgtggtgatgaccacgttgccaacacgcctaagcaattgatgatttatgaagcctttggttggcaaccaccgaagtttggccacatgagcttaattatcaataccgaaaccggtaagaagttaagcaagcgtgacgaaaccgtattgcaatttatcgaacaataccgtgaattgggttacttaccagaagcaatgcttaacttcatcatcctactaggatggtcaccagttggcgaaagtgaattgttcagtaagcgcgaattcatcaaaatgtatgatgaaaagcggttgagcaagtcaccagcagcttttgatggcaagaagttggaatgggtgaacaaccagtacattaagaaggctgacgaaaacgaagtctttgcaatgtcaattcgccaattgatcaaggctggccggttaccacaacgcccagatatgagccagattgaatggacacggacgttggtttcattatttaagaaccagatgagctatactggtcaaatcgttgatttagcagatctcttcttcaatggtccggctgatatcaatgatgaagctaaggccgaacttgataatgacacggcactccctgtcttgaaggaattccggcaacgaatcgaagatattgacgtcttcgaagcaaccgcaattcaaaagacgatcaagagcattcaaaaggatacgaagatcaagggccgggcattatacatgccgatccggatcgccgtttctcacgaaatgcacgggccagaattaccagaaacgattgaattattagggcgtgaaacgaccaagaagcatctcgatgctatgattgcggaactcgccaagtaatgaatggattattaaaatattagttggttgtcgtaagtggcggtcgttgtcagcaagacaacgcaattaatacatcgtgcggtcagcaagctagtccccgggtgagcgttatctcagtatcgcgaaagttacccagtggcgcgtgactgcatatgaaagtatcttttgtatggtggagtttcggttccgccgtgcgagggatgctttttatttgtgtttcaaacatggtaaactatcatcaaaagtaatgattcaattgaaaggagttgtcgccaatatgttaagtgtttttaatacgttaacgcgtcaaaaagaaccgtttaagcctatcacccccggagtcgtgaaaatgtatgtctgtgggccgaccgtttataactatattcatatcggtaatgcgcgttctgcaattgcctttgatactatccgacggtattttgaatattgcggttaccacgttgactatgtctccaacttcacggatgtggatgataagctgatcaaacgtgccgctgaagatcacaccacggtaccagcagttgctgaccggtttattaaagcttttatggaagatacgactgcggtcaatattgaaccagcgacggttcacccgcgggcctctgagaatatcccagaaatcattgcatttgtacaagcattgattgaaaagggctatgcttacgaatcagctggcgacgtatattaccgcgcacggaagtttaaaaagtatggtcagttatctgaccagcgaatcgatgatttagaagtgggtgccagtcagcatactgccgatgaagaaaccgatcgtaaagaagatccaattgactttgcactctggaaagcagccaagcccggtgaaatttcatgggaatcgccatggggtgcgggtcggcccggctggcatattgaatgctcggtcatgtctactaagtacttgggcgatacgtttgatattcatggtggtggtcaggaccttgaattcccacatcatgaaaatgaaattgcccagagtgaagcgaagaccggcaagacgtttgccaattattggttacacaacggttttgtgacggttggcgatgacaacgaaaagatgagtaagtcattaggtaattttgtgacggttcacgatattattaaaacggttgatccgcaagtgctacggttcttcatggcgacgacccagtaccggcgaccgattcaatatacgcaggccaacttagacgaagcagctaataacttggataagttacgtaatgcttatcgtaatctcacgttccggttgcaagatgcgacgaacgggacggatactgcggtggcagaacagttacagacactcatcactaactttggaaccgcaatggatgacgatttcaatgttcaaaacggggtggctgctgtgtatgaattagctaagttagccaatgtctatgcagccaaggcaacggttcaaaaagagacgttgattgccttacaggaggcattagtgcagttgactggcgtcttcggcgtcacttttgaaacggctaatgcgacgctggctgatgacgcgattcaagcactgatcgatgaacgagaagctgctcgtaaagctaaggattttgctaaggccgaccagattcgtgatgatttgaaagctcaggggattattttagaagatacgcctcagggtgtgcggtttagaaaggaataatatgcaagttgattatcaacaattaaacgggattgcactcgcgtacctcggtgacgcggtgtatgaaccgtttattcgccaacatttgattgaaagtggttttactaaagccactaagttgcaccaccacgcgacccactatgtttcagccaaagcgcaagcggcactgatcgaacggatgcaggccgaagaagttttaacgccaactgaagtggacgtttttaagcgtggacggaatgccaagagtcatacgtcggccaaacataccgatgtcgtcacttaccggatctcaaccggttttgaagccgtttttgggtatttacaattgactcagcaggcggaccgaattgcagaactggcacagtggtgtattaaacaagttgatgaagggagggtttccagtgtcaaataacgaacaagaccaaacagcagctgactttgtaatcgggcggcaccccgccatggcagcaatcaagagtgatcaacagatcaacaaagtctttattcaaagcggtctacaggccgatgtactgaatgacattgccaagattgcgaagaaacgtaatttgatcgtacagtacgtgccgaaacaaaagttagaccgtttaaccgacaacgccaaccatcagggggtagctgtgggggtggctgcttttgaatatgccaccattgatgatttatttgctgttgctaaggctaagaatgaagcgccatttttcttgatcttggataatatcgaagatccccataacttaggttcgattatgcggacggccgatgcagctggcgcccatggcatcattattccgaaacggcgcgccgtggggttaaccagtacggttgccaagacgtcaacgggggctatcgaacacgtgaaagttgcgcgagtgacgaacttggttcaaacggttaaacaattgcaagaagccggtctgtggatctttgggactgatatgaacgggacggactaccgacagtgggatgcttccggtgccgttggtttgattattggtaatgaaggtaagggaatttcaccattacttaagaagagtgtggacgaaatgttgaccattccaatgattggtcatgttcaaagtttgaatgccagtgtggcggccagccttctgatttatcaaggctacacgtcccggcatccactgggaaaataagatgaaacaacaattattgattgtcgatgcttacaatatgattggcaactggccagaactcaatcatttaaaacaaacggaccggttgccgcaagctcgtgacgagttaattagcatgttgactgagtataaaaaaattacgggccttaatattagcctggtttttgatgcgatgtacgttccgggtaattctaagagttatcgccaagctgatcttgagattatttggacgagtaaagaccagaccgctgacagttatatcgaaaagtacgcgggtgaaaagcaatcgcgagtacttcaagtgacggttgcgactagtgatcaggcagaacaatgggtaatcttttcggaaggtgcattacgagtaccagccttggaattacgacaccgcgtcaagactgcgctgaaagatgtgcgtcatactgccgtgcgcacccaggatttaggtgccgttcgtaaatcaccctggaatgatgatcaattatcggccttggatcagtaccgccaacaactagaacgcaatcacgttaaacatcatcacaagtaattaggtggttgccgcgagcgtgggttgtttctaaatcgtcataattaatatttaaattttgcaaaagataaccagtggcaatttaaggctcgaaagcagttctagtattaaaatatctagtaatcaaatgccccagttcagctgctgttcactagatgttaggatggcttgtcataacagttttggtgttatcggagtttgcgctggcgattgcattaatcggttggttagacagcgcagtggcttcttgcaactccagcggacgcgcgtactcgtcgccaacgggcttaagtaggtcgcacttgtctttggcgttagcaatattttgatattactaataattagtgcgatatggcactattaggttgatgaataggacgatcatagtagttttgatagccgcgtataagaggatttctgtgagtgctgaggtggctgaattgaaacgttcgttcgcttgtgacggcacaattaacccggtatattagcattacagatgctcaggggtgcagtttctgaaactagtcagaagcgaggaatgtcacgtgaatgaacagcaattgatccacttagcagcagatggtgatgatgcaagcattaatgcattagcccagcagtatgtgccagttgtttggcggttgcggcggcaatactatgtccggaactttgacgaggatgattggcttcaagaaggtcgaattgcagtttatcgagcggctaaaaagtatcaacggatacggcaatgtagctttggcacttattaccgggtgctattgagtaatcagattattgatcatattcggcggacacaggctcgcaagcgtcgtccggaaggggatatcttatcactggatgttaatgatgaggatatcttatgcaatattcagacgctaagggcctcgacccttgatgtggttcatgttcgtgagcaggtgcggatttttccagcaatctgttcggcatttgaaggattggtttttatggatctattggcagggcaatcgccagaacggattgcattgagtcggcaagtggaagttgatcaagtggtcaacgccacggatcgatgccgcaagaagatgcgtgactttttacaagacgctgcctgaaattgacattcgaaaagttccatgctaatgttatacctgatttattatggaggttttgtcgatggcacagaaaaaagttgcactggcatgtaccgtttgtggttcgcggaactacacgattgatgctaacccgaatcgaactgaccgcttagaagttaagaaattttgtaaatattgtggtaaacacacacttcatcgtgaaacgcggtagggggattagacatgcgcttatttaaattttttggtcaagttggacatgaaatgaaaaaagtgacctggccaacttggcgggaaaatcgtcgtgattcgtggacagttgtctcaacatcactgttcttcgtggcgtttttcgctttatttgattggattatccaattattattacaaatgttaacaagctggcattaatggctttttgaacaaatttttgttataataatggcattgaaagaaaacttcgtgcaaacgaggtttttttattttgccaaaagacattttaaaggagaataataatggtcgagtctgttgagaaaagatggtatgtcttacatacctacgctggttatgaaaataaggttagttctaacttggaatcccgtattcaatctatgggaatggaagacaatattttccgggtcgttgttcccgaagaagaagctcatgaagtcaagaatgggaaagacaaagttgaaatgaagaagatcttccccgggtacgttttggttgaaatggtcatgacggaccaagcttggtatattgttcggaatacgccaggtgttactgggttcttaggatcacatgggcaaggtagtaaaccaacgccattgttgcctgaagaagcggaacaaatcttgcatcaactaggcatgagtgctcggcataccgaattggacgttgaagttggcgaacaagttaccatcatcgatggcgctttctctggcctttctggtgaaattactgaaattgacaacgaaaagatgaagctcaaggttaatatcaatatgttcggtcgggaaacaagtactgaattggacttcgatcaagttgaccagattcggtaattaatttaagtaagctggtggaccatcttggcagaagtaattttagtcatcatcggcgccttagtgctcggtattttggggcgtatcacctttaaattttggcaatacgggcgaccgcagcatttgcggcagtcggtgtcggctaattcagcagatgatagcgccgtgacgctatttattccagggtatgcgggcaaccggttctcttttggtggcatgctccaacgttttacggccgggggcatcgccaataagtcattagtcgtaatgattgatcgacataatcatccccatgtgactggtgagctagacgcttaccgcccaatggtacagttgatttttgccacgccacgcgttgctgtacggcaacaggcggcgggcgtcttggcagttgtgcagtatttgattgcgcatgagcacgttcagacgatcaatttagtcgctcattcgatgggtggtgtggtgctctttcaatacttgacgacagctgccaaactggtcaatttaccggaagtccgcaaggttgtcacaattggtgcgccgtttaatgatagtgaggtcgggcaaaatacgtatccgattgaaaaccacccgttgacggcgaccggaccaactaagaccacgcccgtttataattatttttttgcgaacgctccaacgattgccaaacacgatttcgtatttgaatattgcgggtaacattggcgatgcggcgcaaagtgatggtgctgtcgctctgaatagtgcgttgtcattgcgctttttactgcgaccaacgcgtgaccagtatcaagaatttgtggtacatggtaagaatgcccgccattcacgattacatgaaaactatgaagttgatcgccaaatcgtccagtttttatatccagaagccacaaaaaaggttgctggtgaaaaatagatatgctacaatgatgtttgtgcgtcacgtatgcacgtttacgtgggaggagcaaaaactcagctccatttaccacatcacggactaaggaggaatgtctcgtggctaaaaaagtagctaacgttgttaaattacaaattcctgcgggcaaagcaacacctgctccgccagttggcccagctttaggtcaagcaggtatcaatatcatgggtttcacaaaggatttcaatgctcgtactgctgatcaagcaggtatgatcatccctgttgtgattacggtgtacgaagatcgttcattcgacttcatcactaagaccccacctgctgccgttctattgaagaaagctgccggtgttgaaagtggttccggtgaacctaacacgaagaaggttgcaactgtaaccaaagatcaagttaagcaaatcgccgaaactaaaatgcaagatctaaacgcagctgacgttgaagcagctatgcgcatgatcgaaggtactgctcggagtatgggattcaccgtcgaaggctaattcagtactgttgagtatgtcggacacttcatcaaaatgaatgtgtcaagtgggaggaaatctccgtttgaaccacatttgcaaggaggaaaacacttagatggcaaagaaaagtaaacaataccaagacgccgctaagctcgttgatcgtgacaaagcttacgatgtaactgaagcggtagacttggttaaaaaaatggatttcgcaaagtttgatgcaactgttgaagttgccttcaaattaaacgttgatacaaagcaagccgaccaacaacttcgtggcgcggttgtccttcctaatggtaccggtaaagatcaaaccgttatcgtttttgctaagggtgacaaggctaaagaagctgaagaagccggtgctgactttgttggtgaaactgatttagttcagaagatccaagacggttggttagactttgatgtcgcaatcgctacccctgacatgatggcccaagttggtcgtttaggtcgggttcttggacctaaaggcttaatgcctaaccctaagactggtacggttacgatggacgttgctaaagccgttaacgattcaaaagctggtaaggtgacttaccggactgaccgtgacggtaacgttcacgttcctgttggcaaggtatcattcgatactgacaagttagttggtaacttcaagaccattgaagacaccatcgtgaaagctcgtccagcctcagtacgtgggactttcatccaaaacttagttgttacttcaacctttaccccagcggtacgtgttgatttagcatcattttaaggattaaattctgaaaacaattgaccccgtgggtgatctgtgatagattactagaggttaagtaatatctctacctaagactcaggcggcttaacggccttaatctacctgccgaggacattgttttttctctatgtcttggtggacatagggatttttttataaatccctgaaccaaaattctgggaggtgaatctgttgagtaaagaaacaattgctgttaaagcacaagaagtcgaagaagttgcagaacaattgaagagctcagtatcagccattgttgttgattaccgtggtttgactgttgaacaagtaactgatttacgtaagcaattacgtgaagccggtgttaagatgcgcgttatcaagaacaagatcatggtgcgtgccgctgataaggccggatttgaagacttaaaacctgtatttgctggtcctactgccgttgccttctctgaagaagacccagttgctcctgcaaagatcttggctaacttcgcgaagaccgctgatgcccttcaattaaagggtggcgtgatcgaaggtaaagttgctgatcttgaaactgttcaagaatacgctacgatgccatcacgtgaagaattattggctacgatcgccaacttgttacaagcacctgttcgtaacgttgcatacgctgttaaggcggttgctgaaaaaggcgacgaagacgcagcttaatttgctgtcagtgtgttaaaaaaactaaaatataagttcatataaaatggaggaacaaaaaatggcttttgataaagatgctattatcgactcattaaaagaagcttcaatctcagatttaaacgacttagttaaggctatcgaagaagaattcgatgtctcagcttcagcccctgttgctgttgccggtgctgctggtggcgacgctgccgctgctaaggattcatacgatgttgaattaactgaatccggtgaccaaaaggttaaggctattaaggccgttcgtgatatcactggtcttggcttgaaagatgctaagggtcttgttgataacgtaccttcaatcatcaaagaaggcgtttcagaagacgaagccaacgatatgaaagctaagcttgaagaagttggtggtgtcgttacccttaagtagtcaaatacttagagtaacgttattaatccggaaacatcgttgtaatgacggtgtttccggatttttttgtgttttatttacgacagaatcaggtacaacccgatacgattcctccggtacaaaatgttggtacaaattttgtacccaaagaatttttcacaaaactttggtgataggtgttcatcctggaatctcctagcagagtcgagcaatgccattaaaggacaaagtgcaacacgaacattta

SEQ ID NO: 729 - DNA, 107088 bp, Unknown
  Metagenome-assembled genome
ggacctgatttatcaggtttcaacgcacaaaataaagaaaggagcagtgagacactgtaaactttatcggtaaaaaacagcattttttaatcggcaaaaaacgacattttcacatcggcgttgacaaatggcaaagtatgttctgactttaaagtataagaaaagtgtttttagtaagattaagctacactgcgttctcggttgtcagtaccattgcaatcaatcttgtcacgaacttgtaagcggtaatccgcgtcgaattggcaactagggtcaataagcccgtgctgcaattaacttatttgacaataaattaagactaactgttattttacaagtatcaccatgtttacacaatgttatatgcgtatctttaaataaaaaaatctgctatacaataataaaattgaaagcagattaaaaatataagattttatcaagttagaagtgttcaattggtcatatcgttcccaaaattggtcttacttcttttcctgcacgatgtagtggggccggtgttttgattcgatataaatcttaccaatgtaattgccgataatccccagacagaacagctgaatgccaccgattaagagcataatcgtgatggttgaggcccaaccactgacactgttatcaaataatattttacgaataataacgacaaatatactgataatggagattagtgagagcaagccgccggtgaaggtcgcaatcttcaggggtacatctgagaagtcgacgatggcatccattgaataattgaataattgccaaattgaccagtgtgtctcgccagcggaacggggctgattttcgaacttcaaataagttgttcggaaaccgacccagttgaagatgccttttgaaaatcggttatattcaggcaattccaaaatagcatcaaccatctgacgtgtcattaaccggtaatcgcgggcgtttggaataatttgtacttttgaaattttgttgacaactgagtaaaacgagcgtgataagaatgaccggatcattggttcaccaacgcgattttcccgcattgtaccgatacagtcatagtcaccggtttgaagcattgccagcattttaggcaataaagtcggtggatcttgtagatcaacgtccatgacggcgacgtaatcgccaatggtgtgctccaggccggctaataaaccagcctccttaccaaaatttcgcgaaaaggagacatagtggacagtgtcaggatgggcggcgtttaaagttcgtagtacgttcaaagtgtcgtcagatgagccatcattaacgaaaacatattcagtagtgatatccttgaacgactctggattatctgccaagactttttcaacggtgttataaaatatttcaatcgttggttcctcgttatagcatggaacaacaagactcatggttttcataataattgtatccgacctttttataatttttagattgatctattaattaggactcctactgattaataaagaaaggaattttaaaccagtatgaatatcatagcttgaattaaggtataaagcaatcaaatatcaaaccacaaaaattgtaatgatgtcacgatagcttgtcaattacatcaccaatcaagtacgtcgacagcgatgcgtcatgttatttcaaatttcacacctggcagtgttgagtagtttgcaaaaaaacaactccaactgggcacagtagcatggcccgttgaagctgttggaaaagtgattattgtgatttatctttttgagattgggcgatgggtgtcaaggtggacttagaaatattcacaaccgtcaaatttatattttgacaaccgaaatgcccaattagcggatatgaatctatagccgtaaacagctaattatttgcgagcgaaacccaattagtggcctgaatggtatcaattcgatagacagcaatggtgacgtcttttaaggatccataaagtgtccctacaattgttaatggtgaaacggaatcgcccacgcgtacttgccaggtacacttgttgtggaagttcgtccggtcgatacgcagttcaatatgttgattgctcagcgaattgataacgagacgcgagggtgacaggctaatgatatcaccatcaatcggggcattaatcaccggactggtcggttgtatggctaatagcccgatttgttggggtgatgtggcagtgggaatcaccgtataagtaccggcgacgggtgcctgaagactatttcgtttttgatgatgtgagaaccacatatttaccgcgctccttacttagtgcttgtcttaatcgccttatttaataacagcataaattatggaacccgtcccaggtcaagcaattgcgggcagtatttttgtcgtgaaatgctataatagttaagaaatcttaggatggttaacgaacggggtggtcaagatggattttgtagaattgacaccgatcgcattggggcatacgccgcttggcacacgcggaccgaatccccatattcatgattggcaactcgattggcaaaaactaagtagtttgattgctgataatcaagacgtgatgatgcaggtggacgccggacttgctgaagattggttgaatacgcacggcaccatttgggacaatgtacaaggctatcaccgctacccgaatgacaaccgggcgtttgatgacaccgttttttgggcggcgtctacttgggcgacaccggcaattgttgtgacttttcataatgaaattagtcgggctttcagctgctatcgggtcggaactgaccctgattttcattacttagggccacgcggacgtgcatattaatcccttattgtcattaacaaattggaggaaaaaacgtgaaagttggaatcgacaagttgcattttgcaacttcacatttatacgtagacatggcggaactggcgacagctcgccaggcagaacctgataagtatttgattggtattggtcagtctaaaatggcggtgattccgccgagtcaggatgcagtgacgttagctgctaatgctgccgcaccgatgctgacagcgactgacattgcggctattgatttattagtcgtcggtaccgagtcggggatcgacaattccaaagcgagtgcgatttacgtcgctaagttgctcggtttgagccagcgggttcgaacaattgaaatgaaagaagcctgctatgcggcgacggctggtgtccaactggcccaagatcacgtgcgtgttcatccagataaaaaggcgctggtcattggtagtgacgtggcacgctacggattgaacacaccgggcgagccaactcaaggtggtggggcggttgctatgttaattagtgcggatcctaaagtattagcactgggtactgagtcaagtctactgagcgaagatgtgatggacttttggcgaccattgtatcatacagaagccctagttgacggcaaatactcgtctaatatctatattgattattttcaagatgtgtttaagaattacttgcaaacgactcaaactagtccagacacactgacggccttagtttttcatttgccatatacaaagatgggacttaaagcgcttcgaagcgtgttaccattagttgatgccgagaaacaagcccagtggttgacgcacttcgaacatgcgcgtcagctaaatcgacaagttggtaacttgtatactggttcactctatttgagcttgttatcgcagttactgactgatcctcagttacaaccagggaaccgactcggattattcagttatggctcgggtgccgagggtgaattttataccggggttattcagccggattatcaggccggcttagatcatggcttaccacaacggttggctcgtcggcgccgagttagtgtggtggaatatgagaccttatttagtcatcaactgcaatggcgggctgatgatcagtcggtcagttatgctgatgatccccaccgattcgtattgaccggtcaaaaggacgaacaacgccaatatttggatcgacaagtttaaacgaaaaagtcacttgttactagcaaatatgctaggcaagtgacttttgttatttgaagttgttggtgatgatctggccatctttgacactcaacagcgtcttgtcagtggtatctggctgtagcaactgaatggtataaccagccgcaagatttttcttgagcgattttgacaatgatttgaaatttgaagtaatcgtcgtgattgctttttgattttgagatggatatgatttaatcgtcttcaaagatttaacgtactttttattggttggcgtaatcgtatatgttttcgttgacttggtgaatgcaacggtgccaatcgattgatagttagattgtaattgtttaaggatattttcttcattcaacttagtcgttgcggccgcgcgtttggtgttggcttcgttaaaaacgacttgtgaggaactcaagctcgttgatttagacttgctggtactagcgctagtactcgtactagatgatgctttgcgcgtcgattgctgtgactggttgtatggccagtaaggcaatttaacgaccgcgtagatggtgaccagggcgctgaggaccgtaattagtgttagaaatttccaaccaccaccggtttgacgtgcgtaaatcacggaaaataatgctaatagaaaaacaatcaagcccataatggctaggaacaacatgtaaccaactcccaatgtttaaaatagtataatcattataccattgaactattggctgttcgtcacagatttgaaatattttgaaaagagatctgactaataaccaatttgacgccagcactttttctgtcgatacaccgggagaatcaggcgccgctggttcaatagcaatggtgctaccaccaaatcacagtaacgccacggtgggatagtgttgatgcctggcgcaaggtgcctgcagcgtatctctcagcgcacggttgtttacaacaagtgggtggtatatttacgagctaccgataaataggtgcgacgagtaggtatcgcgcttcgattaggcttgaaagaggacgaattgccaatttacaaacggcgatactaacgaatcggggtgatgatgacttttttattcagaaggcaatcggttgggcattgcgggattatggcaaagtgaattcggaatgggggcgtgcttttgtcgcaaataacgtgctctcgtccctggcacggcgggaagggtgtaaatatttgtgagtggaatctgtaggcatgccatcaacctgctctaaaaactggcgaataaaaaagatgacaaattgaattgtcatcttgtgggtgatagtttactgaaacagcatgtcgcgatataaaccgacaactttgcctaatacagagacgttgttcaagataattggggccatcgtgtcgttctcaggttgtagtcggtagtgatcggcctctttgaagaatcgcttgcaagtcgcttcattttcatcggtcatggcaatgatgatatcaccattgtcagcggaactttgacgccgaacaatgacttgatcaccattcatgataccgatattgatcatactttcgccacggatggtgagcatgaaaaggtcgccaccgaatgattcaagttccttaggaattggaaaataatccgtcgcttcctgtacggcaagaattggttggccggcggttaccgttccaagtaccggaatttgatgtggcgtagtttcgacgcccagtgcttcgaaaccggctggcgttacctcaatggcacgtggcttagttgggtctttttggatgtaaccttttttttctagccgtgaaatgtggccgtgaacggtcgaagtcgaagataagtcaacggcttcaccaatctcacgaacggttggcgggtatcctttttcattgacacgttcataaataaagcgaagaacggccatttgtttgctttccgatgttttactcatcttggcacctcattttttattttcattattggttaaaccaattgtagcatagcgtttcatagctttcaaacaaatgttcggttgacaaacactattaattgatttagggtctaatttcgtgtatatttcaagagtgaaaggggctgctgatttgatttcaaaagaattgcttgctcggatcaatgagttagctcataaggcgaaagccgaggggctcaccgagctagaagaagccgaacgtcaagagttgcggcaaaaatacttgaaggaatttcgcgccggttttcggcaacaagttgaaatgcttcaggtttatgataaagatggtaaagaggttacgccagaaaaggtccgtcaagtgcaacgcgatcgcggtcttcgagatgattaaccgatttcaggaaaatttgtcaactgacaaattttccttttcttttattattaatttgtgtagactagtttaatgaagactgtaataagggaggggaatgactgtgtctacaggaatttggattttaatcgtcgttatcggcgtattggttgggttaactggtggtttcttcggtgcccggcactatatgcaaaattacttgaagcaaaatccaccaattagtgaagaaatgcttcgtagtatgatgatgcaaatgggtcaacgcccatccgaaaagaagttacatcagatgttgaattcgatgaaagctgcatctaaaaacgataacaagtagtaaaaaagtgtcggctcgctttaaattgcgatcaccgacacttttttattatcgaacttaatgtttctgacgggttgtagcaggatcaacgtatttgaacgttgggtcgatttgacgatccaagtcgtcaaaagcgtgcaacattttagtttcaatttgtttttgaccagcatcatctagtttcagcttacgatcaatatcaatcggtttaccaaaacggacggtgacccgctgacgactaaaaagttgtttgaaggtcaatggaccttggtaaacggttgggactagtggaacaccggccatcttagcgatgacggttgcaccgcctttaagttcttgtgagtggcgcgttcccgatggaaacatgattaatgaaagcttaccgctgcgcaaaaatttgacgggggtcttgattgctgaaggtcctggatgttgccgattgacaggaaaagcgttcgcatggacgagaatgaaccgcaagacgggattcttaaatagttcttccttggccataaagctaaatttcattgggctgccggccaacgcatagtacaacggatcaaaccacgtccggtgcggtccaactaagatgtaggcgccctcaggcaagttttcccgtccttgatagtgcggccgaccgttaataatggtgatgattagtcggactagtccgcgcataaaagaataaaacatcacgatcttcctttcgtttactaactgctcacagtatgacgaaatttggcaaattctgcaagttaattgtatgataactgtgcgatgattttaatggagaggtggccgaatatggcagacgtcacgttacacgccgatgagcgtattgatcaattatatagtcaagatatccaaatcattcaaagttctcaagtctttgcgttctcactggatgctgttctgttgggtgactttgcccaggttgcgaagggcgttaagagccagatcgtggatctctgtgctggcaatggcgcagtaggtctattcgccagtgctaaaactcaaggccatattacggcggtcgagattcagccccggttggccgatatggctcaacgcagtgttgttttgaacgatttaacccaacaaatgacagtcctgaacgaagacttactggcaattacgcgccaactaccgaaagattcggtggatacagtcttatgtaacccaccgtattttaaagatcgaccgcagagcgttaaaaatccaaatcctcatttggcgattgcacggcatgaactgtccgctaatttagatcagatcctagcggtaactagtgatttgttaaaaatgaatggtaaagcatattttgttcatcgtcctgaacgactagatgacttgttcagtaccatggcgaccaatcggttggcacccaaacggattcggttcgtccatcccaaagcacaacgggaagcgaacatggttctgatcgaaatgatcaaggatgggaaacgcaacggtgttcgaatcatgccaccgcttgtcgtttatcgtgatgatggtgaatacagggaagaggtgcacacattactctatggcaagcacaagtaagccggctgcgtccacgacggcaatcaaaaaatattatttttatgtcctattatgtgctgatcaaacgttgtatggtggttttacggataacttgcagcgacgattagcaacgcacaatgcgggcaaaggggctaaatatacgcgggtcagatcacggcggcctttgcaattaatttatcatgaaactttcactgacaaatcaagtgcgttaaaggctgaatatgccttcaaacaccaatcgcgagctgccaagctaaaatacttgtcagctcacgatgtaaaaatttagcgaagttttcacaatttatgattctatttctcgcatttactgttataatatttactgtatcaatatataggaggaatttttgtaatgaaaattattgcatatgctgtacgtgatgacgaacgtccattcttcgatacttggatgaaagaaaacccagatgttgaagttaaattagttccagaattacttactgaagacaacgttgacttagctaaaggcttcgacggtgccgatgtataccaacaaaaggactatactgctgaagtattgaacaagttagccgacgaaggggttaagaacatctctcttcgtaacgttggtgttgataacttggacgttcctactgttaaagcacgtggcttaaacatttctaacgtacctgcatactcaccaaatgcgattgctgaattatcagtaacgcaattgatgcaattattacgtcaaaccccattgttcaacaagaagttagctaagcaagacttccgttgggcaccagatattgccaaggaattaaacaccatgactgttggtgttatcggtactggtcggatcggccgtgctgccatcgatattttcaaaggcttcggcgctaaggttatcggttacgatgtttatcggaatgctgaacttgaaaaggaaggcatgtacgttgacaccttggacgaattatacgcccaagctgatgttatcacgttacacgttcctgcattgaaggataactaccacatgttgaatgcggatgccttcagcaagatgaaagatggcgcctacatcttgaactttgctcgtgggacactcatcgattcagaagacttgatcaaagccttagacagtggcaaagttgccggtgccgctcttgatacgtatgaatacgaaactaaaatcttcaacaaagaccttgaaggtcaaacgattgatgacaaggtcttcatgaacttgttcaaccgcgacaatgttttgattacaccacatacggctttctacactgaaactgccgttcacaacatggtgcacgtttcaatgaacagtaacaaacaattcatcgaaactggtaaagctgacacacaagttaagtttgactaatctcgattatcactgaaaatggcgtcactcatctgagtgacgccattttttatactttcatctaatggggccttttcgaagcgttaaccccaagcgtactttcaatgctgttattatccataacaaaaagcccacaatcgagctggttgcacggctgtgggcttcacaagtgagcgattttgttagcgataacacaattaagtgttgctaggtaaaggtcttgctagcacgtacttaccgtggttgttaccagcataagttgctcgtagctttaacgccagtatgcgtctatgaagcgctggcggcttgaagaagtgctagcaatagttcatttagttccgctggactctggatgatttgatcaggaattacgctcggtgtcacctggtcattgcgccggtgattaaaccaaaaagtttgccacccagcgtgtttggcactggtcatgtcgagtgctgcattgtcaccaacgtaaacggcttcgttggccttgatgccaacctgatgggcccacgtcgtgaagatcgatgggtcgggtttagcaatacccaattcttctgagataaaaatgttatccggatgcacgaaatgttcaatttgtaattgatgtaacttttgatgctgaatcggcgctggcccattggtaatgataccaattttaaaagcgtgactgagtttagtcagcgtcgcactcagcccatcgaaaaggcaaatctgatttagttcctgctgataggccatttcaaattggatagcccgatcagtgctgatgtggactttgctgggtgctaacgcgtgtcgaatacgggcggtttgccacgcttccagcgtcatagttgtatcagtgacctggttaaaggtacggtcattaaaatcatggaaccggttaaaaatttgtgccaattcagtgctgctcaaagcctggttaaaagttttagttaaggcagcagtgaacggtgatttttgatcatacaacgtatcgtcaaggtcaaaaatgatggcttttatcattattaagtgagccccctatgcgagattgtattttaacacactttcaggaattcacaaattcttgatgaaattgcttgcaagcactagtaattttcggtatactaattttcggtgttaaaaccaattcacacctactgcgataatcatggcggtgctcgggagagtgccatgattagttgaacggtggggaggaataaaacaaattttttggaggcacatttattatggctgttatttctatgaaacaattgcttgaagccggtgtccatttcggtcaccaaactcgtcgttggaacccaaagatgaaaccatacatctttacggaacggaacggcatctacatcattgacttacaaaagacggtcaagatgatcgactcagcttacaacttcgttaaggatgctgcggctgatgatggtgttatcttgtttgttgggactaagaaacaagcccaagattcaatcgaagaagaagcaacccgtgcaggtcaatactacgttaaccatcgttggttaggtgggactttgactaactggaacactatccaaacacggatcaagcgtcttaaagacttgaagaagatggaagctgatggcaccttcgaacggttacctaagaaggaagtttcattattaatgaagcaacgtgccaagcttgaaaagttcttgggcggtatcgaagacatgcctcggattccagatgtaatcttcatcgttgatcctcgtaaggaacaaatcgccgttaaggaagctcaaaagttgaacattccgatcgttgcgatggttgatacgaacactgatccagatgacatcgacgttattattccttcaaacgatgacgcaatccgtgccgttcgtttgatcacttctaagatggctgatgctgtcattgaaggtcgtcaaggtgaagacgaagatgttactgaagattctttcaaggacaacaaggacgctaagaagtccgttgactcattggaagacatcgttgaagctgttgaaggcgacaacgacgccaagtctgacaaataattaattgaaataattaggctgcctaaaaatcgcggaccattacggcctgattttgcgggcagctttttatctaaaatcaagatactcaaaggagagtaaactatggcaaagatttctgcagcacaagttaaagaacttcgtgataaaaccggtgttggtatgatggacgctaaaaaggcgttagttgaaactgaaggcgacatggaaaaagccgttgacgttttacgtgaaaaaggggttgctaaggccgaaaagaagagtggccgggttgctgccgaagggattgctgctgttgcaatcaaggacaacaaagctgccattgttgaaatcaactgtgaaactgattcagttgcttcaactgacaagttcaaaaacttggtaactgaagttgccgacgagatcgctgaagaagaaccagcttccgttgacgacgccttagctttgaagacggctaacgggacggttaaagatgacgtcatcgaaacgacgcaagtaactggtgaaaagatcagtcttcgtcgtttccaagttgttgaaaagggtgctgaccaaagttttggttcatacatccacaacggtggccaaattgcagccttagttgtcttagacggtgctgacagtgctactgctaaggacgttgccatgcacgtcgctgctatcaatcctgaatatgttaaccgtgaacaagttcctgctgaccggttagctcatgaaaaagacgtgcttgttaaggaagccttgaatgaaggtaaacctgaaaagattgttgaaaagatggttgaaggccgtttaaacaagtggctttcagaaattagcttggatgaccaagaattcgttaaggattctgatcaaactgttgcgcactttgtcgaatcaaagggtggcaaggttagctcattcattcgttttgaagttggcgaaggaatcgaaaagaaggctgataacttcatcgatgaagttatgaaccaaattaaagactaattactgactaagggattagctaattggggattacgacggaaagcaattttcggcgtagtccctttttgtaaagtaacgggttgaagccgctttaaaaagagaattcggttaatttttgcgccggattacggctgataccaaacgcttattgaaatatatggtaaaatgatagacagataatttcgaggaggacaaaacgatgtcggaagttaaatataagcgtgtaatcctaaaactgagtggggaagccttagctggtgagaagggctttggaatcaatccccccgtcattaaaacggtggcagaggaacttaaggacgtctatgacatgggcgtacaaattgcaatcgtcgttggcggtggcaatatgtggcgtggcgaagctggtgcccagatgggtatggaacgggcccaagctgattatatcggcatgttagccacgattatgaatgccttggcactccaggataatctcgaatcaattggtgtgccgacccgggttcaaacatccattgaaatgcgacaaatcgcggaaccatacattcggcggaaggcaatgcgccatctagaaaaacgccggatcgttatttttgccggtggtaccgggagtccatatttctcaacggatacgaccgccgcattacgggccgctgaaattaacgcggatgcgattttgatggccaaaaatggcgtcgatggtgtttactcggctgatcctaacaaggatgctagtgcagttaaatttgatacgcttacccatctcgacattatcaacaaagggttacaagtgatggacactacggcaagttccttatcgatggataatgacattcctgtcgtggtctttaacttgaatgaacctggaaacattcggaaagtcgtcgccggtgaacacatcgggacaacagtcagggggaaataatatggcaattacagaaccaattttaaaagaagcacaggaacggatgaagaaggcggaagccgctttacaacgcgagctcggtaatattcgggctggccgggctaacgcatcattattgaatcggatttctgcagattattacggtgcgcaaacaccacttaatcagatggcggcaattacagtacccgaaccacgggtcttaatggtgaccccatttgataagagtgcccttaaagaaatcgaaaaggctattttagcgtcagacctcggtattagcccagctaacgacggttctgcgattcggttagttattccgcaattaacggaagaacggcgtaaagaacttgccaaggacgttaaggcggaaggtgaacgtgccaaggtcgccgttcgaaacgtgcgtcgtgatgcaatggaagccttgaagaagggccataaagatggtcaattcactgacgaccagttacatcagttagaagaccaagcccaaaagttaacggatcaagcgggtaaggacgtcgacgcgatcgttgcggacaaagaaaaagaaattttggaaggttaatgaccgaccaatttattaaggcttggagaaattcaagcctttttttgttgacgaatagttaattagtgctttttttggtaaaatagtgcatagttaagctatttttatggaggtgcgccttgttcgctttttttaataagaatgatcctgcagataacaccgacgtgcaattggatcctgaacgtattccagcccatgtcgccattattatggatggcaatgggcgttgggccaaagcacggcatttaccacgagttgctggccataaggaaggtatgaacacggtcaaaaagattacgattgccgcaagtgatttgggcgttaaagtcctgacgctttacgcgttttcaactgaaaattggaagcggccaactgatgaggttaattacctcatgcaactgccagtgagtttctttgatactttcgtaccggacttgataaaaaataatgtgcgggtgcaagtcatgggctacgttgatcacttgccagaagcaacgcaaaaagcagtccaaaatgcgattgcagataccaaagattgtgatgggatggtgctgaactttgctctcaactatggttcacgggccgaaatcgtgaccggggtgcaaaaaattgcccagcaagtgcaagatggtcaattagcggttggtgatatcgatgatgcaaccatcgacgcagcactgatgacggcaccacttgcgccatacaatgatccagatttgctgattcgcacgagtggtgaagaacgcatttcaaatttcttaatgtggcagattgcctacagtgaactggtctttactgatgtgaagtggccggatttcacagcggcgacccttcaagcctgtatcgcggattttcagagccgtgatcggcgctttggtgggttgtcggatcataaataaaagggagtttttggtatgagacaacgagtcattacggctgtcgttgcgttaattttatttatcccagtcatttttgtgggcggggtaaccttagatattgtggccatgttgttaggggccgttgcgatgagcgagttactcgtgatgcgtaaaaaattattgatttcatttgaagcaatcgtaagcatgcttgcagttatgattcaaattgcaccgaataactggttcaatggcttaccagaccaattaaacaaggagtacgtggtttacttcttagttatcttgctactgttacacactgtgtggtcgcggaatcgcttttcatttgatgatgccggaatgttgacgttaggcgtcctgtacatcgggatgggcttcaactacttcacggctgcgcggggtgtcagtgtttacatgttactcttcctgatgttcattgtctggctgacagatagtggggcttacatggtcggacgcaaactgggtcggcataaagtcacaccgatcagccccaataaaacatgggaaggttgtattgggggtagcgtgattggtgtgatcgttgccagtgcctttgcaattgggtttcacgtcggctatgctagcgtcatcagtatggtactgattactttagtcttatcagtagttggccagtttggcgatttagtagaatccgcgttgaagcgttactatggtgttaaggattctggtaagatcttgccgggacatggcggtatcctagatcgatttgatagtatgttattagtttttccaattgcacatttattcggcctcttttaagctgagtacccgaaacgcgggagaaaggagcgcttaattgatcgttacaattattacgttcattatcgttttcggaatcttggtcatcgtccatgaatttgggcacttttactttgccaaaaaggctgggattctagtgcgtgaattttctgtcgggatggggcccaaggcggtcgcgtttcgtcgtaatgcaacaacttatacgttacggtttctgccaatcggtggttacgtacggatggccggggtggccgatgatgaagatgaagaactcaagcccggaacgccagttagtttgcaaattggtccggatgggattgttcattcaatcaatgctagtaagaagacaacgttgttcaatggaattccactgtcagtgacggcgactgatctcgaaaaagaactctggatcgaaggttatgagaacggggatgaaagtgaagttaaacactacgccgtcgatcatgacgctacgatcgttgaaagcgatggtaccgaagttcaaattgcaccggtcgacgtccaatttcaatcggccaagttatggcaacgaatgttgacgaattttgccggaccgatgaataacttcattttggccatcattacatttgcaattcttgcctttatgcagggtggtgttacgagtacaacgacccacgtagcggcgacgacagcagactcagttgcccgtacggccggtattcaaaagggcgatcaaatcgtggcggttaacggtaaaaaaatgacgagtgcccaatcgatttcgctgttgattcaagacagcccgaagcaacggttgactttgaccatcaaccgggccggtcagactaaaaaaattgcggttacccctgctgccaagacggtctctggtaatcgaatcggtcaaatcggggtccaatgggcgactaagaccgacacgagcctgggggccaagttagcatacggctttactggttcgtggggaattaccaaacaaatttttcaagtgcttggtcggatggtcactcacgggttcagtttgaacgatttaggtgggccggtggcaatctttgccacgacctcgcaagccgctaagtccggggtgcgcacggtgatatatttgctcgccgtgctgtcgatcaaccttggaattgttaatttattaccgattccagcacttgatggtggtaaactattattaaacattgttgaaggcattcggggtaaaccactacgggtggaaacggaaagtgtcattaccttgattggttttggcctcctgatgttattaatgattctagtaacttggaatgatattcagcgatatttcttctaagtgatatttaatttggaacaataaggagaagatttgtagatgaaacagtcgaaattgttaatcccaacactcaaggaagtgcctaatgatgccgaagccttgagtcatcaaatgatgttacgggcgggctatatccgacaaatttcagccggaatgtacgcttatttgccattggcttaccgcgtattgacgaatattgaaaaaatcattcggcaagaaatggaaaaaattgatgcagcggaaatgctggtaccagcagtcattccagctgagttgtggaaagcaactgggcgttatgagacatacggtccagaactattcaagctgaagaaccgccatgaccgagaatttatccttggccccacgcacgaagaaacgtttacgtcaattgttcgcgatgaaatcaaatcgtataaacggttgccattgactttgtatcaaatccaggctaagtatcgtgatgaagatcggccacgttatgggttacttcgtgggcgtgagttcatcatgaaggatgcctattcatttcacgcggatgaggcctcattagatgacacgttccaagatatggcgcaagcttatcagaatatttttgagcgggtcggcttgaagtttcgttcaatcatcggtgatggtggggcgatgggtggaaaggattcccgtgaatattcggccatcgcaccggttggtgaagatacaattgtttattcggatgcgagtgattatgcggctaatcttgaaatggctcggagtttatacgtcccaaagaagtcacatgcttcgttaaaggatatggaaaagatcgatactcccggagtgggcacgatcgacgaactggctgagttcttaaaagttggtgctgaccaactggttaagagtattctgtttattgcagacgatcagccagtaatggcactggttcgtggcgatcatgaagtcaacgatgttaagttgaagaattaccttggtgcggattttttggaaatggctacgccagaacaagcccaacaatatttgggcgctagctttggttcactcggcccagttaacgttcatgatgacgttaaaattgtcgctgaccagtatgtgaaggacatggtcaacattacggtcggggctaacgaagacggtcatcacttcacgaacgtcaaccctgaacgtgatttccacgcggaagcttacgttgacattcgctttgttcaggaaggtgagttatcaccagatggtgcgggcgtcttgaagttcaccaagggtatcgaaattggacatattttcaaacttggcacccgttattctaaagacttgcacgcagaagtcttggatgccaatggacgtaatattccggtaattatgggctgctatgggattggtgtctcacggttgttgtctgccatcgctgaacaacgcgctgatgaaaatgggttgatttggccaaaagcaattgcaccatttgatgtgcacgtgattccggttaacccgaagaaagcggaccaggttgaggttgccgaccaagttgaagcacaattagaagccgctgggtacaacgttttgtatgatgatcggaaggaacgtcctggtgtgaagtttgctgattccgacttaatgggcattcctgctcggattaccattgggaaaaaggccagcgaaggaatcgtcgagatcaagcttcgccagactggtgagactttggaagttaaacaggaagaaatcgccaacaacttggccgttctgctcaagaatatcgattaaaatgctgcaaaactaagttaataaaaatatggcaactacccgttgatagtcgccaacaacaatcacctggttagattccgttgactgggtgatttttgtttgccgattaatcacgtggctcaacggtcagactgtgataaaatagtaacgtttcaagtgaacgatttgtgcgttcactgaagattatttcagatgccgttaatcgccgaggcatcacggtctcggttaagcaaactgacaaagtagtgccaactgtggaccgcggccctgagcacttaattggggttctagttaatattaaaagtcttgcttggcgttgggttagttgttagcgactaagtcatcgttgaaacgggattctgtttctagtgggtcacggttagcagcttttgattttaagattggatttgctttaatatatatgcaagcgcaaattaacaagtacggtgcgtgtcttactaactgattgtaatcaacaaaaggaggaccactggtgagtttaaaccaacaagaaatgttcgagaagttactcgaacaaattgaaatgccaacggggcctgaatttacagaagcagcgatcgataaattgaccgttcatcaagcttccaaggtttgggaatttcatttgcatttccaacatgttttaccttatacacaatttatgacttttcaaaacaaactccaaatcgcctttaaagaaattgcacgcgtgacctttacgatcgtgactgatgataccgaggtcaatggtcgtgaactagctgaatactgggaatggatcgttcagcacagtgggatcaagtcgcccctggtccaatcattgtgtaacagcaacgtgccgacttatgaagatggtcgggttattttgttggctgaaaatgaagttattcaaaattttctaactaaccaagcattagggccgattgagagtacctatcatcgcttgggcttcccgaagttctccgtccacacgatgattgatgagagtgcttcacaggcgaagatcaaggaatttcatgaacaaaaagcgaagtctgatcaagcgttggctcaaaaagcggaagcggctatcaaaaaggccaatgagaaacggcaaaagcaggcggatgcaccagcaccaattgatggtcctgtccaattaggcaagcagatcaacccgcaagagccggctaaacagatggtccaaattactgaagaagaacggtcggtcgtcgtggaaggctatgtcttcgatatggaagtgcggacgttgcgttcccagcggcagttattgattctaaaggtgaccgactatagttcgtcaatggtcgtcaagaagttctcacggaatgctgatgacgaggcacaattcgcggcactgaagcctggaatgtgggtacgtgtacgtggttctgtgcaggaagatagttttatgcgcgatttaacgatcaatgcgtatgatattaacgaaacgtcgcatgccagtcggcaagacacggcgccggcagatgagaagcgggttgaattgcacttgcattctaatatgagtcagatggatgcaaccaacagtgtcagtgattatgtcaaacaagccgctaaatggggccatccggcgattgcgattacggatcattcgggggcacaggcgttcccagaagcgtttgcggctggtgaaaaaaataatatcaaaattttatacggtgtcgaagctaacatggttgatgacggggtgccgattgcttataatgacgcccacgttgatttgaaagagtccacctacgttatttttgatactgaaacaacggggttgtccgccatttatgaccgggtcatcgaattgtcagcggttaagatggtcaaggggaacgtcgttgatcagtttgaggaatttattgaccctggttttcacttgtcggaaacaaccactaatttgacgagtatcaccgatgatatggtgcggggctctaaatcggaagaagaagtgtttaaacttttccgcgaattttatggtgatgcaatcgtggtcggtcataacgtcacctttgatattggctttatgaatacgggctatgcccggcatcacatggggccgattacaaatccaattattgatacgttgacgctggcgcggtggctgtatccgaatttacgcgggtaccgcttaaacaccctagccaaaaaattcaacgttaatttggagcaccatcaccgcgccatctatgatgctgagacgactggtcatttgaaccacctgtttttgaaagatgcggaggaccgttatcaggttcaattccacgatcagctgaatgatcatatgaatgaaaatgcggcttaccgccatgcccggccatttcatgcgacattgtatgcgcaaacccaagcggggttgaaaaatctcttccgaattatttccttgtcgaatgttgagtactattaccgcgtgccccgtgtaccccgcagtgttttaaacaaatatcgggatggcatcctggtcggttcggcttgttctagtggtgaagtctttactgcaatgatgcaaaaggggaaggaagaggcccgacaaaaggccggctactatgacttcctggaagtacaaccgaaaccggcatattcggcgctgatcgagagtggtttgattgctgatacggatcatttggaagaaattatcagcaacatggtggaactaggccatgagatgaatatcccggttgctgctacgggggatgtgcattatctgaatcctgaggataagatttatcgtaagattttgattcattcacagcccggtaacccgttaaatcggactgaacggccagacgtgcattttcgctcaacggatgagatgcttaaagatttcgatttcttaggtacggagacggcacatgaggtcgtggttgacacgccccgcgcgcttgctgaccaatttgaaatcgtgcgaccggtcaaggataagttgtatactccgcggatgaagggtgccgaagcggaaatcgaaaaactgacgatggaccgtgcccatgcgtggtacggtaatccgttgccagaaatcgtccaaaaacgggtggataaagagctgaagagtatcatcggtaacgggttctcggtcatttacttaattgcccaacgcctagtgtttaagagtaataaagatggttacttggttgggtctcgggggtcagtcggttcgagtatcgtagcgacgctgtctgggattactgaagtgaacccgatgccaccgcattatcggtgtccaaattgtcagtactcgcacttttatacgaataacgagtatggatcgggctatgatttaccacctaaggattgccctgaatgtgggactgacatggtgcgtgatgggcaaaacattcccttcgaaacgttcttaggattttatgggaacaaggtgccggatattgatctgaacttctctggggactaccaacctattgcccataattacaccaaagtcttgttcggtgagaaaaatgtgtaccgagccgggacaattggaacggtcgctgataagactggttatggttatgtcaaggcgtatgaacgggatacgaatcaaacacttcgttcggcggaagttgaccgattagcaaagggaacgactggcgttaaacggacgactgggcaacatccggccggtattattgttgtgccggattacatggatatttatgatttcacgcccgtccagtatccggctgatgatcagagtgcggcctggcaaacgacccactttgatttccattcgattcatgataatattttgaaaattgatattctgggacatgatgatccgacgatgattcggatgttacaagatttgtcgggtgtccaacctgagagtattccaccagttgatccgcacgtcatgaagattttctccagtcctgaagttttaggagtcacagaagaccagattttctcgaaaacggggacgctgggaattccagaatttgggacgcggtttgtccgtgggatgctcgaagagactcacccatccacgtttaacgaattacttcagatttcaggactttcacacgggactgacgtgtggttaggaaatgctgaagaattgatcaaggatggcacggttacgctggccgaagttattggttgtcgtgataacatcatgaccgacttgattcactacggcatggaatctgatatgtctttccaaattatggaacacgtgcggaagggtcgggggatcccggatgaatggcaacaagcaatgaaggatgccaacgttcccgactggtacattgaatcttgtctaaagatcaagtatatgttcccgcgggcccatgcggcagcctatatcttaatggcgttgcgggtggcttactttaaagtgtacttcccgttgatttattacacggcttatttctcagtccgtgctgacgattttgacctggttgcgatggcccatggtaaagatgctgtcaaagcgtcgatgaaggcgatcactgacaaagggatggatgctagcgccaaggagaaaaacttactgaccgttttagagttagccaacgaaatgttggagcggggctttaaattctccatggtcgaccttgacaaatctgatgcttcggattggctgatcgatggtgatacgttgattgcgccgttccgagcagttccggggttagggttgaacgttgccaagcaaatcgttgctgcccgagcggacaagccgttcctgtcgaaggaagacctgtctaagcgtggaaaagtgtcgaagagtttgatcgactttatgactgaaaatggtgtgttaagtgatttgccagatgaaaaccaactctcgttgttctagaaaacacgacaattgttaaagtttgatgaatttttgcggtggttgatgcatttaacagcactcagacagatttatctgatttagggcctgtaatgttgatacaccggcaattgtcaggctgttgaagcggaagcttactgtgacttgaaagctaacggctaaatgctataaatggcgtaaacttgcggtttcaacataattgtgctaacatatgggttgtaatttaaaactcgttaacgagtgagcagcgatgctcactctttttattggactaatctgaataggaggcgcagccttgagtagtaatgttgttgaaaccattcagccagtggccgcagccattgtcagtgctcaccagtttgaactcgtggatcttgaatttgttcgcgagggtcaaagctggtatttgcgattatacattgacaaaccgggcggcattaatattgaagaatgtgcaatggttagtgatgaacttagtgaaaagctagatgcgatggagcctgatcccattccccaagcttactttttggaagtttcttctcctggtgcggaacgcccattgaagaaggaagcagattttcaaaatgctattggtaagtacgtgcacgttggcttataccagaagttggatggcaagaaaatttttgaaggtgatttgacagcggtgacgccgaccactttgaccatcgattacttggataagacacgtcacaagacggtgacgatcaaccgagaacaaatctcacaagcccgcttagcggtaaagttctaaataagtaaaggagtctacacatgagcaaggaattattaggggccttagacaccctcgaatcagaaaagggcattaaaaaagaagttgtcatcgaagccttagaagcggcactcgtttcagcctataagcgtaattatggccaggctcaaaacgttgaagttgactttgaccaaattaagggtaatattcacgtttatgccgttaaagaagtggttgaagacgtctttgattcacgtttagaagttagtttgcaagatgcattggctatcaaccgagcctacgaaatcggtgatgatattcgatttgaagtaacaccgaagaacttcggccgaattgcagcgcagacggctaagcaagtcatcatgcaacgagttcgtgaagcagaacgtggcattatttatgacgaatacagccagtatgaaaatgaaatcgtcactggtgaagttgagcgccaagataaccgatttgtctacgttagtttgggcaaagtagaagcggtcatgggtcgttctgatcagttacctggtgaagtttatcggattcatgacaaaattaaggtttacgtctcgaaagttgaaaacgcaacgaagggcccccaagtattcgtttcgcggactgcaccagatttgttgaaacgtttgtttgaacaagaagttcctgaaattttcgatggcatcgttgaaatcgtttcgattgcacgtgaagccggtgatcgggcgaaagttgctgttcgttcaaacaatcctaacgttgatccagtcggtacctgcgtcggtcccaagggacaacgggttcaaacgattgtcaatgaattacacggcgaaaatatggacatcgtggaatggacggatgatcaagccgtatttatcgcgaatgcattgaacccagcggaagttttggatgttatttttgatcctgaaaatgagcggggttgtaccgtggtcgttccagattatcaattatcattggcaatcggtaagcgtggtcaaaatgctcgtttagctgctaaattgaccgggttcaagatcgatattaaatcggaaaccgaagcttctgatataatggatgcaaaccctgatgatgttgcagttgccgaaacggaaacgactgaagcagcatcagacgcggcagtgcagtccgataccggcgaagatgaggaaccagcaacgtccgacgcagccgtggcgacgcctgcctcagaaactgctgtggatgaatcagcaagtgacgctgaataagttcgtcactaagtgagtgaagtaactaaaggaggtctgggattatgaaaaaaagaaaagtgccgttacgaaaggacattgtgacgggtgaaatgcatcccaaaaaagacttagtccgggtcgttaagaataagcaggatgaagtgtccgttgatccgactggtaaaaagccgggacgcggcgcctacattgccttagacgtacaagttgcacaacgtgccaagcaagaaaagacttttgataaggcgtttggtatcaaagtgggtgcagacttttacgatgagttagtggcttatgttgatcatcaacaagcccgaaaggaactcttcggaaatgacgcctaagcaagcttgtttaaacctactgggcctttcacggcgtgccagcaagcaaattgcaggcgaagggctagccctggctgcaattcgtaatcagacggctaaactggtctttattgcaagcgatgccggtcccacgactgccaaaaagtttcatgataaggcccaatcttatgatgttccagtgatcgatacctttactaaagcagaattaaatacggctactggtaataagcgcactgtttatgcaattaccgatgccggatttgccaagaaaatggtggcgatcatgacacagtaaaggagggtgaagatatggggaaaaagcgaatttatgagttagcgaaggagctcaacgtcccaagtaaacagctgattgcgcaagcacagcagttgggattctccgtcaaaaatcatatgtcgacactcggtgacagtgaggcgcgccagttacaaggcacgaccacagttacccatcctaaatctcaaccggctccagctaaaacgagtcgggctacgcaagccgtagcaaaaaatgtgacacgaactgctaatcagcagcaatccaactcgcgtcatcaacagagtggtgattctttgaataataatcgtaataataaccaaaataatagtcaaagtcgtaatagtaacggtaatcgaagcaataacggcggtaaccgtactaacagtaataacggcaatcgttcggccaatgcttcacggagcaacagtgctcgtaataacggtgggagcaatacgaaccggtctaacaacaataataataataaccggtctaataataacaatcgctcaaatacgagtaacaaccgcaccaacaatactggtaatcgaagcaataatggtggtcagaaccggaacaacaaccggactacgacgaataacagtaaccggagcaatgggtcgaataatagttcgcgtaatggcagcggccgctttggtggtagtttgaatagcaacaataacggtggtggtcgttatcgtggcggtaacaacaataaccgtcggcgtaacaaccggaacaataagagccggaacaataagaatcaacggatccgccaggtcaataataagccagcgccagttcgtaaggacaagccgttgccagaaacactggtttacacggtcggcatgaatgcccaggatttgggtaaattattgcaccgtgaacctgctgaaattatcaagaagttattcatgttaggggttgcagttaaccaaaatcagtccttggataaagatacgattgaaatcttagccactgattacgggatcaatgcgcaagaaaaggtccaagttgatgtgaccgatttggacaagttctttgatgatgaagttaataataccgacaatttggcgccacgggcaccggttgttacggtcatgggacacgttgaccatgggaagacgaccctattggaccaattgcggcatactcacgttacagagggcgaagccggtgggatcactcaggctattggggcttaccaagttaagcatgatggtaaggttattacattcctggatacgccaggacatgcggcctttactgaaatgcgggcgcgtggtgctgacatcaccgacatcaccgtgttagttgttgctgctgatgatggggtcatgccacaaacaatcgaagccatcaaccatgctaaggctgctaaagtaccaatcatcgttgccgttaacaagattgataagccgggtgccaaccctaaccacgtgatggaacaattgactgaatatggtctgattcctgaagattggggtggcgatacaatctttgttcagatttcagcgaagttcggtaagaacctagatgaattgttggatatgattttacttcagtcagaagtgcttgaattaacggccaaccctaagcaaaatgctgcgggatctgtattggaagctagtcttgaccgtggaaaaggttctaccgcaacgttacttgttcaacaagggaccatgcatgttggtgatccaattgttgtggggaatacttacggaaaagtccggacgatgaccaatgaccatggtaagcggatcaaggaagccgtgccatcgacgccaattgaaatcactggtttgaatgatgtgccggatgctggtgatcgcttcgtggtctttgatgatgaaaagacggcccgtgatgctggtgaacaacgtgctaagcaggcattgatggaagaacggaagcaaactgctcacgtcaccttggataacttgtttgattcaatgaaacaaggtgaacttaaggaagttgacgtgattattaaggctgatgttcaaggttctgttgaagctttagctggtagtttacgtaaaatcgacgttgaaggtgtgcgggtcaatatcatccatacagcggttggggcgatcaacgaaagtgacgtggccttggcggaagcaagtaacgcgattattatcgggttcaatgtgcggccaacaccacaagccaaagcccaagccgatactgacgatgttgatattcgcttgcatcaagttatctacaacgcgatcgatgaaatcgagagcgcgatgaagggaatgctcgaaccaacttataaagaagaaatcactggtcaagccgaaatccgtgaaatctataaggtttctaagatcggtacgattggtggtgggatggtcactgatggtgtcatccaccgggattctggtgtgcgggtcattcgtgatggtgtcgttatttatgatggcaagttagctagcttacggcgtttcaaggacgacgttaaggaagttaaacaaggctttgaacttgggcttcgaatcgaagattacaacgatattaaagtcaacgatgttattgaagcttacgtgatgaaggaagttccagttgaataacctttaaaagggggattagcagatggcgcaacattatcgagttggtcgtttggaacaggaaatcgaacgcgaagttaatgatattttgttaaaacgggttcgtgatccacgggttgcgggtgtaaccattaccggtgtaacggtaactggcgaccttcaacaagcgaccatctactacagtattttgtcagataaggcatccgatggtgaaaagacggcggctggattgactaaggcgacgggattaattcgtagtgaattaggctcacgacttagcatctataaaaccccggaattaacttttgaacgcgacaactcggttcaatacggtagccggattgatgaattaattaataacttaaagcgtcaagattaggcgctggaaaaatagtcgttgtgaatccagatggattgtcagcgactattttgtgttcaaattgaatggagccgttcgctgtcaatcactgaggttcagcggtttagatggtgctgattgtagggtcacactagtcattcacacactgcttgaacgttgtcggtagactgactaatcaaggtagcctgctcgcgaccgtcgcaaacaattggtttaatgagtagtcgtactgaagacgatttttgtaaatagtagtaggatgaggcgaattacgcatcgtggggcttttacaagcgaaaatgatttcttaattgcaaaattaaaatgaaattagggttgacgaatcaaaatgagaatgttttaatataaacaatcaatgaaacggaaaggatagatgattatgacgacgttagcattcaacgcaacttattattatggctttgcttattttaggtagcgcccgtgttggaaccttagatacggacggcacctacgttcgtgtctaagcgaagtcaattcatcttggccagctagacaccgtgagtctagctggaataatatcatcaattaggattaaattttgatgagccggctagattttcacaatctagccggctttttttatttccacgaaggagttgttattcatgcgtcagcaccaattatcaatcagtctttacttaaactactttattcatggtattggcttaattattttaacgcaaaatatgcaagcgttaggtcaacactggcagaccccgttagcgacggtttcctatgtcatttctgggattggcattgggcgcttactggcctactttattctgggaaatttatcagatcgttttggccgtaaagtcttcgtcaatcttggcatggcttgctacttcacgttctttgtggggatggcattggtcactaatattcagctggcatacggtttggcgattttggccggtattgcgaactccgcgttggatgcgggaacctacacgacgtttattgaaatgggtgggcggcaaggttcagccaatgtcttattaaaggccttcatgtctgccggtgaattcttattaccactgctcgttgccaactttgaagcacaaagaatctggtatggctggtcatttatcctggccgcggcaatcctagtggtcaacagtatcctgttgaaccggcagcagtttccactaaaaaatcaagttgctcaagccggaacgggcgtatcccagcaaccacttaagaaccggcgctggttggcgacagttggtttagctggttatgggtatacttcgatggcacttatgatcctctacacgcagtgggtcagcttgtttgccactacgacgttgcatttttcgtcagtgttagcgcactggttgctttcactttacagcattgggtcaatcaccggcgttattgtgattttctggttgttacgtcgtggggtggcagaaaccaaattgttgttggcaatgaatggcggctcgctgctggcgttagcggttatctgttatagtccagcggctgggctgtccatgctggcggctttcgggtttgggtttactgctgcgggtggcgtgatgcaggtcggcctcaatttatttatcaaaggctatccccacatcaagggccgaatcacaggaatttatttcacgtttggcagtattgcttccttcacgattccgctcgtgactgggtggctgtcaaagcaaaatattgcgaccgcgatgcgctttgatttagttattgctgtcagtggtctcgcctttgtcggcctagctgtatgggcgctacatgtcccaaccacacttagtcaagaacgccaacgtatcaatcatattgaccagcaaatcgtccgattactcaatcaacgttttgagacggttacagccatcggggagttgaagcaacaacagcaacttccggtattagaccagcaacgtgaacaacgggtgttacaacaagttgcggtgaagagtatccagaccgcgcataccccttatttacaagctatttatcaagcaattatgcataactcacgcgcatatcagacggatttacacacgaatttacacaaggaggatattgatcatgattaattacgttacggcaggcgaatcgcacgggcctcaattgacaggggtgctgaccggtattccggctggcttacagctagacattgatgccattaatacaggcctcgcagcccggcaaggtgggtttggccgcggcaatcgccagcagatcgaacatgacaccgtccaaatcactggtggcgtgcggcacggtgttacgctaggttccccgattgcattaacgattatgaatcgcgatcacgcgcactgggcagcaatcatggatccggtaagtccagctacggcaaccaatacgttgcggcaagtcactcgtccacgtccggggcatgctgacttagtaggcggaatgaagtatggtcatcgcgatctacgaaacgtgctagaacgttcctcagctcgtgagacagccatgcgagtggctatcggtcagatttgtaagcaattattggcgcagctagatattcacctagttggctacgttcaacaaattggccctaagcaagtgacggccgatttaacactatccgttgatcaattacaagcccaaatcgcgcaaaatgatttgcgattaccagatgcggccttggttcccgaaatccatgagctgatcacagcaacgaagaaggccggggataccttgggtggtgttatccgggtcgttgccgaaaatgtgccggctggtttgggcagttacacgaactgggataccaaattagatggacagttagctgcagcagtgatgggagtcaacgccatgaaaggtgttgaaattggtgatggatttgcggctgccagccattatggtagccaagtgatggatgagattagttgggatgaacacgccggctggtcacggttgaccaatcatttgggcggctttgaaggtggcatgactaatggaatgccgattgttgttaaggccgccatgaagccgattccaacactttacaaaccattacaaagtgtggatatcgcgaccaaagtcagccaaaaggcgagcgtagagcgttcagacacgacggccatcgtccccgcctcgattgtggttgaaagtgtggtagcgattgaattaacgcgagcattgacggcaacgtttgacgggagtaacttagctcgcttccagcaaacagtgacggcataccgcgaagaactccgacaatattaggagggcctatgcagattcatactttaggcccgaccgccacggatagttacgcggccgcgcaagtttataatcatcgcaactggcaggaccaagcggtgattgtcaaacacccgagctttgaaaccattttaactgatttaacggcctattctggtgaccaactggtgataccagctgctttcaaatcagacacactgaatgccagctggggggatatacattacgcattattgtcccaattaacgttgagcagttgttttatgacccagctcgatccacttgtcgtgctccaacgagtaaatgccgataatcaaattggttacacgcatgcagcgaccgcccaattgttgacgagggtcgtgcatcaggtcgtggtgcaaacagtcgccagtaagtatttagcgtatcaggcttatcaacgtaatcaggcggcctacgtgctaactaatgagaaaaacgtgacactgacgactcatgaacgtgaacttgcacgtttgacaccttcgatggtgtggtgcgtctatcaaataaattaggtgatgatgattaatgataaaaaaactaagtattcaaccagctagtgggttacaaggtgacttaagtgtaccaggcgataaaagtgtctcacatcgaggcttgattttaggggcaattagtcaagggacgacgaccttgcaccactttttgccagccgccgattgcttatcgactttaacggcgctgcaaaagttaggggtgccaatcaagcgtgtcgatacgaccgttacgatcagtggccgcggcttacgtgggttgacccaaccacaacaaccattagacatggggaatgcggggacggccactcgcttattaactgggttgttagccggtcaaccgtttgagacgaccttggtcggcgatacgtcccttagtcaacggccgatggagcgagtgcgtcaaccattacaagccatgggggcgcaggtacaattaacagccgggcacttaccgatgacgatcactggtcggactttacatggtagtcgtaccgagatgcaggtcgctagtgcacaagttaagagcgccttgattttagcagccctgcaagccgatcaggcaagtacgattattgaaaaattaccgactcgtgaccacactgaacggttgttgcaacaatttggtggtcaaattgaaacggcgcctgatcaacgaacaatcacggtccaaccgcagccagccttggttggtcagtcactaacgattcctggcgatttttcctcggctgcgtttttcgtgacagccgcgacgattattccaaattcacatgtccggttaacgaacgtgggactgaatccgacacgaacgggtttcttaaacattttacgacggatgggtggtcaagtgacggtcgatcatgaacaccggatgggcgaaccagttggcacgcttgacgtgcggtttgcacaactgcatccggtccaagtcactgctactgaaattcctgccgtaatcgatgaactgccactagttgcattgttggctgcgactgcgaatggtattagcacaatcagtggggctgctgaattacgagtcaaggaaaccgatcgcattgcaacgattgtgaccgagcttcgaaaacttggtgttcagatcacttcgcaaccggatggcttcgtgattgatggtcgcaagtcttggcggcagccgaccgagccattagccagccatggcgatcaccgaatcggtatgatggtggcgattgcagcgttgcgattagccgctcccgccgaactagagtccgccgaagctgtgaacatttcatacccgacgttctttgaagatttagcacgtttaagccagggggtgtgaagatgacaactgtattgatcaaaggtttggggctaattggcagttcgttggcactaagcattaagcaggcccatcccacggtgcacattattgggattgatcgtgacgatgtcagcctgagttatgcgcgtcaacagggtatgatcgatgctagtggcactgatttggccgcggtcgcgagcgacgctgatgtgattattttagcggggccagttgatgtgatcgttgctgacttgcaccgactggctatgatgccactcaaggcaggggtgcttgtgacggatgtcgggagtactaaacaagtggtgatgcatgccgcgcttgccatacaacagcacggtgtgactttcatcggcggtcatccaatggcgggttcacataaatcgggtgtgacggctggccgcgccaacttattcgagaacgccttttacttgttagtgccgggccggactaatcaagcagccgttcaacggctgcaagcattgttaaaagcgactcacgtcaaatggttgacggtcactgcaatacagcatgaccggattgtaggacagttaagtcatttgccacatattgtcgctgcggctttagttgatcagactcaggtggctttggcagattcggcactcgggttgcgattagcggctggtgggtttaaaagtattactcggattgccagttcggaccccacgatgtgggcggccatcctgatgactaatgctgaactaataaccaatcaattgcaggattatattgaccaactgttgcgcatcaagacagccattagggtgcatgatcaagcaacattgtacgaattttttgcgacagctaaggtgacgcgtgatcacttgggaccggaacagttgggaggactaccaaacttttatgatttgtttttgaacgtccccgaccgtgttggcgctctcgcggatgtcactcagcggctcgcacaggctcagctgagcttagtcaatattcatattttagagattcgtgaagagattgatggtgtcttgcaactgacgtttagtgatctaaagacgagaacgcaagcatcgtcgttgttagctgatgcgggttatcagattgtaaggaggaattaagaatgcgagcaattttaattggatttatgggtagtgggaaaacaacggtcggtcggcttttggcggccgggttagcaactaaacatgctgatttagatgatttgattgttcagcgggcgggacggtcgattacgactatttttgcggagcaaggagaggggtacttccggcaattggagcatcagactttgctccaagcactcgaaacacccgggattttatcgaccggtggtggtactccgaccattgcaatgaatgcaattagtctgaaacaaagcacggtgccagttatctggttgacggctagtgatcaaaccactattaaccgtgttaaaaatgatactagccgaccacttgtcaatgaattggatacaggggcactgattgcgttgaagcaacggcgccaagccttatatgccgctgcggccgatttgacgatcgcaaccgatcaactgacaccccagcagattgcccgccaaattcagcagtggctgaatcagcaaccagttgcgctccaggcttgaagaaccatgtaactgtcaactgtggttagcgtgccggttgcattttaagacgataacattgaataagcgtacatcagccacactaaggtcgttgcacgcttttttgatggcagcatatgttgaaagtcatcggcgtaattagggacggtcccgcgcggtatccttttgataaggggactaatttgtgcgattcttgtttttcagtcgttttatttgactaatagggattaagctcacggttttctggatcaatgagttaaatacagctttgccaggcacatacgtggtcgtcagtggcaccggaccagcgtgtcgatttggggtatcttagttgcggtgctcagggccttgaattctgtgataatccgcttacatatttgtgaggtgtggtatactgaaaaccgtcgattaagaacgatcgaatccgtggcacggcgattggctgccactagaaaccgaatttaaatgattgaaggcgttttttatgttgaacgggattctaccattatataaacctcgtgggatgacgagctttgactgtgtcgctaaaatccgacgactctatcagacccgcaaagtaggtcattcagggacactggacccaaatgtggatggcgttttaccgatttgtattgggaatgcgactaaagttgtgcaatttttagtggcttctggcaaagaataccaagggagcattaccctcggatttgcaacgactactgaagatttagatggtgaggagattgcgcgccaagcggtcacagagccgttcacaagtgaccaagttgatgctgcgctggcacagatgacgggggccattacgcaaattccaccgatgttttcagcagtaaaagtaaatgggcggcgtttatatgactatgcgcgcagtggtgaaactgtcgagcgcccagaacggcatatcacaattagcagcttcaagcaacggcaggcatctacctatgactcggcaacccagactcagacgatctattttacggtcgcttgtagtaaagggacttatgttcgcacgctagcggtggatgtcggcaaagtgctcggggtacccgctgtgatgagtgatttgacccgattaaagagtggcggctttactttagatgaaaccgtgacctttgaggaaatcgcggcccacgtcgatgctggaacggccggagcattattggcgccaattgataaagctttaagtcagtacccgcgagtcacgttaacggatgagcagtggcaacgggtcaaaaatggggcctttattacggcggcagaagggcaacaaactgatccagatgcgaacacgatggttgcgttagtttaccaaaacagcctaaaatgtctatatagttatcgaccggacgaacagcggtacaagccgttcaaaatgtttgcggtcaattaaggagtttttgtcatgcaggtgattaatttaaagtatcccgtggcgttgagtcagattcccgaaggaccaatcgtattggccttaggattttttgacggcgttcaccgtggacatcagcaagtcgttgcaacggcacgccaggccgctcaggcgcaacacgccaaactagcggtgatgacgtttgaccagcatccgtcagttgtttttaaacacactgatccgcagcaagtccgttatttaacgacaattgatcaaaaaacggcattgatgagtgagctcggcgttgacatcttatatgtacttcactttgatgccacggtcggtgccatgccaccccaaacgtttgtcgatcagttaattgttggattacacgcacaaacggtggttgctggttttgattacacgtacgggccagctgaaattgcaaatatgcagcgtttgaatgactatggtcataaccggtttgaaatcattgaagttcctaaggcggaattagatgctgaaaagatcagttccacgcggattcgccgcgctttggacgcgggagatatcgatacggctaaccggttactgggctatcaatatgaaactgccggcgaagtagttcatggtgaagcgcggggccgaacgctcggctttccaacggccaacgttgctcacgggcccaatacccgggttcccggaattggcatttacgcgacgatggtgcagattgggacacgctgggttatgggaatggcctcagttggacgaaatgtcacgtttggtgatcaccgaccaatcacggttgaaatatacttattaggtttccaaggagatctttatggccacaatttaacggtgcgttgggggcaccggatgcgcggtgaaattaaatttgctggggcggatgccttggttgcgcaattaaagcgggatgaacaaaacacccgtgactattatgtggcgcatccctttgtggtcacaccccggattcaagttgcacaacaatcaaatcgtttggaggcacaatgaatggacacaacaacaatttttcaacacggcacattaggcttacttgttcccggattatttgacgggacgattacggctggtgaactcttaacccatggtgatacgggtattgggacgttagacggtctcaatggtgaagtgattattctaggaggtcacgcctatcaagcacgtgaggatggtcaaattcgggaaattcagcccgaagagacgttaccatttgcatcggtgcactttgaaaagcctgatattagtgcgcaattagctgcaatcacacaaactgatttcgagcaacaagtggttcatgactatcgtttgaccaacgtgtttgcggctattcgcgtcgatgggacctttgcaaaagtcaagacgcgagtcgcgcctcgtcaggagccaccgtacaaaacattagtcgcggcaacggcaacacaaccggaattcaccggtgaacatgttgacggaacgattattggctactacgcaccgcatttgttccaaggcgctacggtcggtggctttcacttacactttctaagtaaagaccatcaattaggtggacacttgctggggtttgaagtcgaacaagcgacgctgaaagttcaacattttgctgactttcatgtgcacttgccaatcgacaatgaagcgtacttacaagaacaatttgataatgaaaccattgatcatgccattaataaagctgaacgttgattagtttgaaagctgattaccgttaaggccaggtttcactagaatgtctgttggcaatgtacatcaggctagtcaaaaatctcgagagtctgtaactcttgagatttttttgttgtggctggtgtgctgagtaatggcagcagaaaagcgagtagtctgctaggcaccatgcttgcattgtgaagggtgagggtgtatattagcactcgtaagtaaggagtgctaattgggggcgacggtcaattaagtccagtcatagtgggactggtgtcctaataatttaagcattcttttctagaaatactttgtctttccttgactttcatcagggtggttgttatattagtaattgtgttagcactccattaagttaagtgctaaaaagaggtgatgatcacgttaactgaacgacaaagcctaattttaaaggccattgtccgtgactataccgagggtggtaatccagttggatccaaatcgctagttcaagaactaccgatcaaggtcagttcagcgacgattcgtaatgaaatggcccgactagaagatttaggattaatcgtcaaaacgcatttgtcttcagggcgaattccatcgattaaggggtatcggtactatgttgaccatatcctaaagcctgaaaaggtggatggcaaagacttgaaggtgattcaacattcattaggcggtgaatttcacaagatcgatgagatcgttgctcagtcggcggatatcttgtcgcaactgacaagttacacgacctttacattgcgacctgaacttaaagatagtcggttgagtggtttcagactcgttccgttggggaatcatcaagtaatggcgattctagtgacgaataatggtgacgttgaaaaccagacgtttactattcctagtgacattaccggcgatgagctggaaccggtcgttcgtttcatcgacgatcaactggttggcctgccgttacaagacgtcctccgccaattaacgcatgagattccgttaaaacttgcacagtatttgcaagatccagatggtttcttagatatttttggcagtgtgttgtccaaggcagcttccgagcgcttttatgttggtggtaagttgaatttgttcaactatacggaccagcagagccctaaagagttacagtcattgtactcgttactcgaccaaacggaccggttagctaacgtgattggtccacccggtcaacggattcaagtccgaatcggtaatgagatcaccaacgatttgttgaagaactacagtttaattaccgcgacttacgatgttgatcaacacggacaaggtgtgattgccttgctcgggccgaccgccatgccgtattcacggatgattggactgatgggtgcgttccaacgagaattagcccgcaaattattagattattaccggtactttgacgagtgacggacagggagatgaaaacattggcaaagaaatcaacgcggacgacgccggaagattcacaagcgtcaacaactgattcagcagcaatgtcaactgccagtgaagcgacacaggcagcgacgagtgcgactgatgatcaagctgagcaaacgacagcggtcgatccgacacaacaaattactgatctcaaagcgcaattagatgcgaaagatgaccagttattgcgtgcacaggcggagatcgtcaacatgcaaaaccgctacaaaaaagaacaagcggcgctgttgaaatatgacggtcaagcacttgcaaaggatgtcttaccagttctggataacttggaacgggctttggcaacgccagctgacgatgaagcggcccaacagttgaagaagggtgtcgaaatggtctatggccatttacaggatgctttgaaaaaacatggggtcaccgaaattgcggctgcgggcgaaaagtttgatcccaatattcaccaagctgttcaaacggtgccagttgatgatgatcatccagctgatacggtagtacaagtcttacaacggggttacctattgaaagaccggaccctccgtccagcaatggttgttgtggcacagtaattaatcaataaaaatactaaattaaaaagaggtttgttaatttatggcaagtaataaaattatcgggattgacctcgggactactaactctgcggtagcggttcttgaaggtaatgaacctaagattatcaccactcctgaaggtggccggacggttccttcagttgtggcattcaaagatggcgaaactcaagttggtgaagttgccaagcggcaagcaatcactaacccgaatacggtagcttcaatcaagcgtcacatgggtgaagctggttacaaagttagcatcgaaggtaaggactacaccccacaacaaatctcagcaatgattttgcaatatatcaagggctttgctgaagattacttgggtgacacggttgaaaaggccgttgtgactgttccagcttactttaatgatgcccaacggcaagcaactaaggatgctggtaagattgccggcttaaacattgaacggattattaacgaaccaacggcggcagctttagcctatggtttggataagaccgacaaagatgaaaagattttagtctatgaccttggtggtgggacttttgatgtttccatcttggaattaggcgacggggtcttcgaagtattatccacaaatggtgatacccaccttggtggtgatgactttgaccaaaagattatcgactggttagttgatggctttaaagctgacaacggtgttgatttatcaaaagacaagatggccttacaacggttaaaggatgctgctgaaaaggctaagaaggacctttcaggtgtttctgaagctcaaattagtttgccatttatttccgctggtgctagtggcccattgcacttggaaaccacgttaacacgtgctaagttcaatgaattaactgctgacctagttgaaaagacgcgcattcctgttgaaaatgccttgaaggatgctgatttatcggctagtgacttagacgttgtcatcttgaatggtgggtcaactcggattccagctgttcaagaagctgttgaaaagtggactggcaaagaatctaaccattctatcaaccctgacgaagcggttgctttaggggccgctgttcaaggtggtgtgatcactggtgatgttaaagacgttgttttgctcgatgttacgccactttcacttggtattgaaaccatgggtggggtcttcactaagttgattgaccgtaacacgacgattccaaccagcaagtcgcaagtatttagtacggcggctgataaccaaccagctgttgacattcacgtgctccaaggtgaacggccaatggcagcggataacaagacgttaggtcgcttccaattaacggatattccggctgcacctcgtggtgttcctcaaatcgaagttaagtttgacatcgataagaacgggatcgttaacgtatctgctaaggatatgggaactaataaagaacaaaagattaccatcaagagttcatcgggtctttctgacgacgaaattgatcaaatggtcaaggaagccaaggaaaacgaagaagccgataagaaacgtaaagaagaagttgacttgaagaacgaagttgaccaattgatctttactaccgacaagactttgaaagatcttgaaggcaaggtttcagaagatgaagttaagaaagccaaagatgctcgtgatgctttgaagaaagctcaagatgataacaacattgacgaaatgaaggccaagaaggacgatttgaacaagatcgttcaggacttatcagttaagttgtatcaacaagctcaagaagctcagggtgcacaaggcggtgccgacagtaatgctgctggcaatgccgactcagccaagggcagtgatgacaacacggttgacggtgatttcgaagacttggataaagacaaggataagaagtagcaccggcagaacaaaaaggccaaggccacgtggctttggcctttttgctttaaatatgctagtattaatgagacttaattaaggttcattaggaggttacaatggcagagcaagacttatataaggttctgggtgttgaaaaggatgccagtcaggacgaaatcaagaaggcgtaccgcaagctttcgaagaagtatcatcctgatttgaatcatgaacctggcgcggaagaaaagtttaaagctgtcaatgaagcgtacgaaacgttaggcgatgcccagaagcgggcacagtatgatcaattcggatcgactggtggccaacaaggtttcggtggcgccggcggtttcggcggtcaagactttggtggcttcggcggcggtggcggctttgaagatattttcagttccttcttcggtggtggcgctggtggttcacggcgttctaacccaacggccccgcaacaaggccgagacttacagtatgagatgacactgaagtttgaagatgcgatctttggtaagaagacgaccatcacctacaatcgtgaggaacagtgtgagacttgtggtggctctggtgccaagccaggaacgtcaccagtgacctgttcgaaatgtcatggtgctggctatattcaggtacagactaatacgccactcggtcgaatgatgagccaacaagtttgtgacgtttgtcatggaactggtaaagaaatcaaggacaagtgtgccacttgtggtggctctggtcatactgaacaaagtcattccatcaaagtgacggttcctgctggagttgaagaaggccaacaaatgcggcttcaaaatcaaggtgaagcgggaacgaatggtggcccttatggtgatttattcattatcttcagagttgagccaagtaaggactttgaacgggatggcgcgacgatttacttcaagttgccgatcgacttcgttcaggccgctcttggtgatgaagttcaagttaaaacggttcacggggacgttaagttgaagatcccagctggtactcagacggggacaactttccggttacgtggtaaaggtgcaccacgattacgtggcaatggcaacggcgacgaacgcgttaccgttaatattgaaacgccaacgcacttgaacaagggtcaaaaagaagctttgaagacctttgctaaagctagcggcaaatcagttgctggcaatggcaagagttcgttatttgacaagcttcggggtgtttaaccgagcgaactaattccagaaatatacaaaaagctgggcgatgcccatcacaaaaatgtgatgaggattgttcagctttttttagtgtcaatcaagcactccggcctgtttattaagtgacctttcagtaacacggtttttgtgcaaactgtttcgttatcctgtcgtccggggattagtgagtgctagaattagtcaaggaggtgaagtaatacgctgctagcttacgggggacgtaacgttgatgttacaaaaccgttacaaatatgtcgtatcagcgaacgaaaatgcaggattttgatctttttgagccggcctaaccgttattggtcggtaggttgttacactataacttgaacttacgtcctattggcggcgtagctaatatcaccaatcggttcgtaattgatagctaatggggaggtcaatcattgtgaagcaaagcaaacttttagtaacagttttgcttggactgctgattgtgggtgctggtggcggctactatgtttatcatacagagcggcaagcagcgattgctaaaaagcgtcaaactgacaaagcattgaataagaaagcggcattaaaaaatagccagcttagtcgtaagattaaccagacaacgttttcgaataataagaacacggatgagcaagtgactaaggctttaaacctaagccattttgtggggtcagcattagttgttaagaatgaccatgtcatttataatcgtgcctttggttacgcaaacaaggctaaaaatcaacgtaataaagtcaattcaaagtatcaaattttatcgattcaaaagtcaatgacggcggttggcattatgcagttggtgcaggcgggaaaagttaagctgactgatccgatttcgaagtattatccaactttaaagcatgggcgtcagacaacgcttcgccaaatgttagatatgacaacagggttccgtttgaagagcggttcaaaagaattcttaccagaaaatcaagtgattgattttgcggctcacaatgttttttactacccagataaaaatggaatttataattattcatccgttaattttctgttgctagctggcattattcgcaaggtaactggtcaatcatatcagcacttctttacaacacattttattgacaagttgaatctgaatgaaacgggctttttgattcatggtcaaggtcaagatgcgacaactggttaccgagcgcttgcagaccaaacacttccgaattatgatcaaacaatgccagaaagcaaatcacaaatggccaatgagttaggtactgggcaagtttatatgagtacagcggatttatttaccgttgaaagtgccattcttaaagggcagttgctgtcaaaaaagaacgttgcaattttgcacacgcgcacagccacaggtgaatatggcggtggtgtttataacatgagtaatggtattcggtcacacggacttggttatggctatgaatccagcatcttcctctcaccggatgggaagactggtgttgtattaatgagtaactactatcgcaaagctgctggtattcaagcaacagccaacaagatttttacggaattaatgaagggtgatattaagtaactgacattgggttagtggaggaggtgatggcatgtttgcaaagttgaaaagctggtttcaacgtccggtcgttcaattcattgcacttacagtattttactttgctgtcatgctcgccttggtttatctttacggttatagtgggatcaaccaagcgaagtttatttacaacgaattttaaaaatggatgcagtaacactattgtttggggggagttttaattatgattaagaacatcattacaacgattgatgattatgcacggacgcaacccaataacgtggtttatgatgtgcaaggtgtaacgcacacttatgcggaattaaaagcttattcagatgccttggcggcgcatcttgacacgctcgatttaccagccaaggatccaattattgtgtttggtggtcagacgtttgaaatgattgcgactttcttaggagttgttaagtcaggtcgggcgtatattccaatcgatacacattcaccaaatgagcggttaacaatgattaatgagattgctaagccagctgccgttattgctgttgctgatttgccaaccggtgtcgggacaacccccgtgattacaccagatcaattggcggctatctttgcgactcccgttgattatcaagcggatcatgtcgttagtggcgatgataattactatattatctttacttctggtaccactgggatgccaaagggggtccaaattagtcatgataacttggtcagttacgttgactggatgttgagtgatgacttcggattgcctgaccagccgaactcgctgtcgcaaccaccatattcatttgacctatccgtgatggacgtttacccaaccttagcgttaggtgggacactatacgcattaccgaaggccgtgacagatgatttcaaacaattatttgctgcgttgccgacgttaccaatcaacgtttgggtctcaacaccatcatttatggacatttgtttgctagaaccaaagtttaatgctgaaaacttgccaactttgacgcacttcttgttctgtggtgaggaactcacacataagacggcggcgacactcaagaaacggttcccagatgcccggatcttcaatacgtacgggccaactgaaacctgcgtcgcggtaactcaaattgaaattacggatgccgcattagcgcagtatgatcggctaccaattggttatgccaaagctgatacgcggatacttgtggttgatgaaaatggtgaggcggttccaaatggcacggaaggtgaactgattatcgccggaccatccgtttcgaaggggtatttgaacaactctgaaaaaactgccaaggctttctttgaattagacgggcaacccgcctatcattctggtgatattggcacgatggatgcggacggtctgttccgttatcgtggccgcgttgattttcaaattaaaatgcatggttaccgcatcgaactagaagaagtggatcacttcttagcacagcaacagcatattaaacaagccgttgccgttccaaaatacgataaagagcacaaagtaacgcaaatgattgcgtacgtggtaccaaagccgaatgacttcgaaagtgactttgctttgaccactgcaattaaaaaggacctacaaggaatgatgatggaatacatgattccacaacggttcgtctatcaaacgagcttgccattaacgcctaacggtaagattgatgtcaagtcgatcattaaagaggttaacccagaatgatttcttttgacccatatggtaacccaacgtactttgtgctgctctttatcgcgttgttaccgttaatgattggtctgttatatggtcggcgatcccattggtatgaatcattgatatcgtttatcttcttaatgctgacctttggcggtgttaagtggcgcactgggatcgcgttaattatctatttggtctatcagatcacactagtttggttgtactcaaagtatcgacaacgaccagattcacctaataagggctgggttttcgttgtcagtgtgattttagcgattattccactagctgtcgttaagatcacaccagccgtggcacatggtgctaattcaattattggtttcttaggaatttcctacctgactttcaaagtggtccagatgatcatggagacccgtgatggggtgattaaagaattccatccggtactgtttggccagttcttgctgtttttcccaacgatctcgtctgggccgattgaccggtatcggcggttcgttaaggattacgatagtgtcccgacccgtgaaaagtatctcgggttagttgaaaaaggggtccgctacattttcttgggattcttatataagttcattttggcttatatctttggtacgcggatgctacctgtcgttgaacacgcggccttgcaagctcacggcatgtcatgggcgttagtcggtgtgatgtacgtctatagtatggatttattctttgattttgcgggttacagtttgtttgccgtcggtatcagttacctgatgggtgttgaaactccgatgaacttcaatcaaccgtttaagtcaaagaacatcaaagacttctggaatcgttggcacatgacgttgtccttctggttccgtgatttcatctacatgcggttggtattctttatgatgaaacacaaggtctttaagagccggatcacaacggccaacgtggcatacgttattaatatgttgatcatggggttttggcacggggaaacatggtattacatcgtttatgggctattccatggtttagcaatggttgtcaacgatgcttggttacggtacaagaagaaacatcaagcgcagttgccgtctaataaatttacggaatactttgcgattttcctaacgtttaacgtcgtttgtttcagtttcttgatcttctcaggattcttgaacacgttattctttggggcccggccataatataattacaataagggagcgtaatgacaatggatgatacaaaagcaacggttttatcaattttagcagacttaacgggggaagatgtttccagtaacatggacgttaacctgtttgatgaaggaatcttagattcaatgggttccgtccaacttttattggaacttcaaaatcaattaggaatcgaagtgccggtctctgaatttcaacggtcagaatgggatacaccggctaagattgttgcaaaggttgagaacttgcaatgaacgttgccaaacgcctttttaagatttttgggccaattattttggcagccgtcttattattggccgtactgctttcaccgttctcatttggattaaaccatatttctaaggatactgagaaaaaagcggccgtttccttgtcagccaacgtattaaaaggtcggttagttaaacgacaggcgctggatgatggctatgtcccgttctttggttcttcagaatggtcacgatttgatccaatgcatccgtccgtactggcaacaaaatatcaccgcaattaccgaccatttctactcggtgcgcgggggacccagtcgttgacgcagtatttcgcgatgcaatcggtgaaaaagcagattacaaataagaaggccgtctttgtaatttcgccacaatggtttgtgccacaaggaacgcggaaagatgcgttttcgtactattactcaccactgcagaccattgattggttacaggatgagcagaatacggcaatggaccggtatgccgctcaacgtttgttacagatgccatcgggttcttctgatcgcattttggaaggcgccctggcacgtgtggcagctgggtttaaaccaacgagcgcacaaatgacgtatattaactataaggcacgtgtccttggcagtgaggatgagttcttctcacgttttggaattgcgggcaaaaatttacggactgtcaatgcgcaagctaacaagttaccagcgacatataactttaatcagttaaaccaattagccggtaaaatcggtgcggcgcaaacggactcgaacagtcttgaaatcagcaatcaattttggaacacgaagttaaaacgtaattacaagcgactcaaagattcacagcgacacttgaattacacgaagtcaccagaatttgccgattttcaactggttttgaatcagtttgcaaagacacacaccgatgtcttgttcatcattccaccaatcaatcagcgctggtctgcttataccggactgtcaatgaagatgattgctcagtttgacaagaagattcagtaccagttgaagagtcaagggtttaataacgtcttggacctgacccaggacggtggtaaggactacttcatgactgatacgattcatcttggctggcgtggttggttagccgtggatcaaaaggttgatccattcttgactaagaagacgaagccggttcattatcagattaatgacgacttctattcaaaagaatggcaattactcaaacccagtgaaatcaaggattttgaataacctactaaaaagtacaggccatattggcttgtacttttttgttacgtcatttattcagtggcgcagcggggtgtctggagcggtctgatagaaaaattgtgcttgtgccactaacttggtataattgtagggattaggatttaggaagaaagtaggaaaatcaatggataaagcgacaatgcaagaccgacaacaacatattcggaatttttcaatcgtcgcccatattgatcacggcaaatcgacgttggcggatcgtattctggaactaactgatacgatttccaaacgtgagatgcaagaccaagtgttggactcaatggacttggaacgtgaacgtgggattacgatcaaattgaatgcggtagagttacactatcaagcaaaggatggggagacttatatcttccacttgatcgatacacctggacatgttgacttcacgtatgaagtctcacggagcctcgcagcctgtgaaggggcggttttagtcgtggatgcggcgcaaggggtcgaagcccagacgctagccaacgtgtatttagccattgatgatgacttggaaattgtcccggtgatcaacaagattgacttgccatcggctgaacctgaaaaggtgcgcaaagaaattgaagatgacattgggattgatgcggaagatgctgttctagcttcagcgaaagccggtattggtatcgaagatctgctcgagcaaatcgtgcataagattccggctcctcagggggatcttgatgcgccactcaaggccctagtgtttgattccgtctatgatgattatcggggcgtggtgctgagtgttcggattcatgaaggcatcgttcgtccaggagatcggatccggttgatgaacagtggtagtgaatatgaagtgacggaagtcggcgttaattcaccgaaaccgttagcacgggattatttgatggcgggggatgttggttacattacggctagcatcaaggatattcaggatacccgagtaggtgatacggtcacgaacgcgaaaaatccggccgaaaagccattggcgggttaccgtgaaatgaatccgatggtctacgctgggatttatccgactgataatgccaaattcaccgatttacgggaagcgttggaaaaattaaaattgaacgatgccgcattggaatttgaagcggaatcatcacaagcactgggctttgggttccggtgtggattcctgggactgctacacatggacgtcattcaggagcgcctcgaacgggaatttaatcttgaactaattaccacggcgccgtccgtaacgtatcatgtgcggatgactgatggcacggagaaaaaggtggaaaacccggctgaaatgcctgaggcgtctgcaatcaaggaaattcgtgaaccgtatgtgaaagctcagattatggtgcctaatgattacgttggtgcggtcatggaattagcccagcgtaaacggggcgagtttgatacgatggagtacttggatagtaatcgggtcaacgtggtttatcacattccgttgtccgaaatcatttttgacttctttgataaattaaagtcgaacacgcgcggctatgcctcgttagattatgatttagacggctaccgtgccagtgatctcgttaagatcgatatcttattaaacggtgaccaagttgatgctctgagctttatcgcacatcgcgactttgcacctgcgcgtggacgcgagattgccgccaagctcaagacgattatcccccggcaaaactttgaaattccggtacaggcaacgattggttctaaagtcattgctcggacgaatattaaagcttaccgtaaggacgtgacggcccatctgtacggtggtgaccggacgcggcggatgaagttacttgaaaagcaaaaagctggtaagaagcgtatgaaggctgtcggtaaagtcgaaatcccgcaagaagcgttcatggcggttctgaaaactgacgaagacgaaaagccgaactgattaagtttataaaaaatggtagcgacatcgattgatgtcactaccattttttgcgttattgtttagatgcaattgtaatctgattaagatggttgtaagcaccaattaaccccaaacatcatccatatgcggtagttgtaataagccatcgctagtcgggtcagttgtgccgatggtctttaaatgccaagtgccctgatcgtccttggtcgcaacgacttttttgcgtttgccttcttgatttttgtagaagcagttttcactatccgcaccgatttcgcgggcgaggacttcgttggatgtgacataaccgtcattggtttgaaatttttcgatttggtcgaccgttgtcaactgttcatgaccacgacgataaattctttcgatgagtatcatcagtaaattccccctatattgataaccttactaatttaatcatattttaccatactcggatacgcggcaaaaacaattctgaaatggttagcaaatttataagaattaaagttcgatacttgctaaaccaatggcaaattggtacactacttgtttaaagtctgctataataatagctagatatgaaaatatactaacgataaattaatttattatttaatcaatttcacattgtgaaggagagatcaacgacatgttaaaacgcacgaaacagtttctgcgatcaatacattatgactacgataaaacatatattagaccgctgatggtgcccgacagcgtttacgtgttgaaattcggtaaggaccatcgcaacaatcgggtggtcgttaagtacagtcatacttggaccgggcgaatcaaaatcaatgagatcgcggttcggttgcacaagcaaaagcacccgcggatctttaagcatgaagccgacatgattaagtatttgaataagcatctaaccaaaaagaccgcaaataatgattaaatgaacatgaggacggactagcaaggtggctagtccgttttctattaggggcgagtaaaacaagttatgatagcaatcgaacgatttttaagcacacgtacgacacctgaaattgcggtgagcctactgggtaaacagttgcgcttacagacatctagcggtgtattgaccgcctggatcacagaaacagaagcgtatcttggtgcccgtgatgcaggagctcacgcgtatcagaaccaccaaacgccgcgcaatcgcgcactctggcaatcagcgggaacaatttatatttatcaaatgagggcctggtgcttactgaatattgtgacacaagctgccggtacgccagaatgtgtcttgattcgcggaattgaaccagatgcggggcttgaacgaatgcaacagcagcggccagtgcccattgcgaacttgaccaacggaccgggcaagctaatgcaggcgcttgggttagataaaacgttaaatggacaaacgctgcaaccggcgaccttatcattggatttgagtcattatcgccaaccggaacaagttgtggcgactccgcgaattggaattgtcaacaagggtgaatggacaacggcaccattgcggtactttgtggctggcaatccattcgtatccaagatttctcgccggaccatcgatcatgaacatcatggttggatgaccaggtgattgtcaagttaatcaggcttgttatataattgttactaagaaaaacgtgatagtcttaagcgatggcgcttggcgctctagctttcgatgggaggaaaatataaagatatgaaatggactgaagtaacggtcagtacttctaatgaagctgtcgaagcggtggcaaacattttaatggaagccggggccagtggcgtcaaaattgatgatgccttggattatcagaatttaaagcctgatcggtatggtgagatcatcgatttggcgacgattccacacgttaccagtggggcgaagatttctgcttattatcctgagacggtgtttgtaccggaagtcattccaacgatcaagcagcgggttagtcagctgactgattttgggttgaatccagcacctaatgaagtcagtatgacggctttatcggatgaagactgggcgactgcctggaaaaaatactatcaccccgtccgagttacgcgctatttgacgattgtgccaagttgggaacagtaccaaccagtgcaatcaggtgagcttgtgttgcgactagatcctggtcaggcttttggtaccggaacgcatccgacaaccaagctctgtttgcaggcgcttgaaactgtgatcaatggtggtgaacacttgatcgatgtgggtactgggtccggggtattgagtattgcggccaaagcgatgggcgtcggtgcagtagaagcttacgatcttgacgatgtcgctgtggcatcagctcaaacgaatttggacttgaatccagttgccaaagatgttcacgtggctgccaatgatttattagctgggattgacacgcaggctgatattatcgttgccaacattttggctgaaattattattccgttggtaccacaagcccgtcaaaacttaaaacggggcggctatttcattacctctggcatcatcgatgataagttccaggtcgtcatgacgacaattaaggaagcgggcttccaaattacacaacatacgcaaatgggtgactggcacggtatcgtggcttatctaccaacagctgaagattagtggaggactgaaatgcaacgatactttttatcaacaccgattacgacaacgatcgggcaaacgttcactatcacgggtgagacggtcaaacactgggtcaaggtgatgcgcgcacaaccgggggacactgcggaattcgttacgacgacacatcaagtcgtgctggcggatttggtgaaaagcgatggtcgaacagctacagcgacaatcacggccgttacgacgccccatgttgaattgccgttgccagtgactattgcttgtgggttgtctaaaggcgataaacccgaacagatcgtacaacgtggtactgaattaggtgcgagcgccttcgtgtttttcgatagtcagtgggcagtggctaaatgggcagcgaataagcgggcccgcaagttggcccgcttggcgaaaattgcgcagggcgcggctgaacagtcacaccggacgatgattcctagtgtgagctacgcaacggatttaaaccagttgttagcacacgtgtcatatgataccggggtcgtagcgtgggaggaatcagccaaacaaggtgagagcagccaactggcgcagacgttaaaaacgatgaccgcaccacaacgactgctggcgatttttggtcctgaagggggcttggcaccacaagaagtggcgacattacaaactgctggtatcgcggcagtgggcctgggtccacgaatcatgcgggccgaaacggcacccctctacttactaagtagcgtttctttttggtgcgaactagtgtaattttgcggtcggtggtgtacaataaataatcatagtcatttagcaataaagcgtaagcgagggagttagtttgacggaaaaaattcgtaagtttaatggccagtattggctgattgcgcttgtcgttggggtgatgataccatggttgctacgatttacgagtattagccggtttcatcagattgtatggctactctttgtagttgactttgtgctggcagcagtcgttggctggtggattcgtcggactgaacggacgggctggttagtctggctattcccagtgggctgttttgtcgggctctatctatttttcccaacgtatgtctattacttagcgttagttgatttaggcatatcctacttagcatatgggttaactggtccccgcgcgagtttgcgttaaaacggttgtcaaggcacgttgggtgggaacctcacgtgccttttattaaatagaatctttgtggaagtcgtggtgataaaatgcccaaacaacctacctggactgcccaggatgtcctggacatggttcaaaagtatatgaatagtgatcacgtcgcgttagttaaacgggcgtgtgattttgcaacttatgtgcataaggatcagtatcgccaatctggtgagccgtatattatgcatccgattcaagttgctggtatcttagctgaattgaagatggaccctgaaaccgtcgcttcgggtttcttacacgacgttgtggaagatactggtgttactttaggagacgttgaagaactgtttggtcatgacgtggccgttattgttgacggggtcaccaagctgggtaagattcggtacaagtccaacaaagaacagcttgctgaaaatcaccgtaaattactgttggcgatgtctaaagatattcgagtcatgattgtcaaattagctgatcgcttgcataatatgcggacattgcagcatctgcggcccgataaacagcggcgaattgcaaatgaaacgttggaaatttacgcccccattgccgatcgattagggatcagcacgattaaatgggaactagaagatatttcactacgttatttgaatcctcaacagtattatcgcattgtccacttgatgaattcgcggcgtgaggaccgtgaaaagtacatcgagattgccattcaagacattcaaaaggcgctccatgatctggaactaccagaagctgaaatttatggtcgtccgaagcatatctattcaatttataagaagatgcgggacaaacacaaacagtttagccaactttacgatctgctggcaattcgggtggtcgtggattcaatcaaggactgttatgcagttttaggtgcgattcacacacaatggaagcccatgccggggcgttttaaagattatattgcgatgcccaaggccaatatgtatcaatctttgcataccacggtggtcggtcctgaaggtaagcccctcgaaatacagatccggacgtttgaaatgcaccgggtcgctgaatacggggtcgcagcacactgggcgtataaggaaggtaaacgcgacgaggtccaagagactcagtcgggcaacaagttgaacttagtcaaagaaatcattgagctacaggatgaaagtaaggacgctgccgactttatggagggcgtcaagggcgacctctttagtgaccgggtctatgcttttacgcccaagggtgacgtgacagaattaccaaagggcgctggaccactggatatggcatattcgatccatacggaagtgggtaaccatacgactggtgcgaaagtcaatggcaagatcgttccattggattaccaaatcaaaaatggtgatatcgtggatattttaacgtccactagttcaactggtcctagccgtgattggcagaaattagtctatacgcggcgggcccgtaataaaatcaaacagttcttccgcaatgctgaccgtgaggaaaacatcattacgggtcgtgatttgcttgagaagcagctacgtgatttagagtttaatccaaaagaaatcatgactaaggacaaggtgacggcggtcgctcaaaagatgcactacggtagtgaggatgatttgttcgcggccttggggtttggtgacgtccaaccggtagggattgctaaccggttaacgagtgatgttcgtaaacagcgcgaggctaatcggcagcgtgaacgtgaggaggccattttggcagactctacggaagcgccagcgaagaagaaatcgaaagatcatcataatgaggatcaggagaagcaggatcggaagcggcaaaaggtctcatcttctggtggggtgattattcaaggcgtcgacaacttactcgtacgtctaagtcattgctgttctccaattccgggtgatgagattgttggttatattacgaaggggcgcggtgtttcggttcaccgtgttgattgtccgaacgttaagagcgcagaagcaaatggtgaacggttgattgatgttcagtgggagaatcccgagggtgaccgaacgaactacaattctgatttggaaattcaaggttataaccgtaatggcatgctcaacgatgtgttgaaagttatcaataatcacacgaaatttttgaccaatgtcaacggtaaggtcgatcacaacaagatggtcattattagtgtttcgttgggggttcgcaacttggaacatctccaacgaatcattgacagtctgaaaaatgttcaggatctttacgttgtcgaacggaaaatgttttaggaggcttctatgcgagtcattgttcagcggtcacagcaggcacaagttagtattgatgggaaagttcggggcacgattgaccacggtttcgtcctattggttggttttcaagatggcgacggtcaagccgaattggattacatcgcgcataagattttaaacctccgcgtttttagtgacgcagatggaaaaatgaatttgaatattcaacaagtcggtggagcaatcttgtcgatatcgcagtttacgttatacgcggagacgcgccatggtaatcgaccaagttttacagcggcgggtaatcctgaattggctagcaaattgtatgatacatttaatcagcaattagctgccagtggcgtgaccgttgcgactggtgaatttggtgccgatatgcaagtttccttggttaacgatgggccggtcacgatttgttatgatactgatcaacgttgaagtaaaagctgaaagaccaatccggtactttcagctttttggctattacaattattagcgggagtgaatgagatgcgtgagtttttatgggacctcgatggaaccttgttagatacttatccagccatggtccaagctttccaaaaagcagttgccgagttaggtgggactattccggctgatacaacgtaccagctgatgcggcaacagtcagttggttatgcggaaagaatggttgcggctcagtatggttgggattggcatgatttacgggcgggctatcaacgttgggagccacaattacagcatgcaccggccgcctttgcgggtgctcaagcggtgcttgaaaaagttatcgcagttggtggtcacaattatttgatgacccatcgtgacgaaagcgcacaagcctatttacaacgagcgggtttagcccaatatttcacagatgcggtcacggctgctcagccattcccacgtaaacctgatccagctgcgttgaattatttattgaataaacaccaggtcgaccgtcaacgcgccgttatggtgggtgatcgcaacttggatatcgatgccggtcacaatgctgggattgccggatatttatttgatattgactgcctgattacggtgactagtgccccggaagttcaagttacggatttaaacgacttattgacctttgtcgactagtctagacactcgaaatattgtgatagctgatgattgtagctaaaaaattgtatacaagcctcgtgaccgagtcctctcaatgagctgcacgggtcgcgaggcttgtattaatattgcatgagaattcggtcaacggctggtccgtatgtttcaccaaagaggttcaggtgggccagtaaataatagagttggtagcttggtaggcggtcttgcataccgggcgcaaccgggtaggctgcttggtaagcctgataaaaatcagtatcaaaaccaccaaaaatcgtcgtcatggccagatccgtctctcggtcaccgtaaaacacgtcgggatcgatcaaaacgggcgtaccggtcgtgtcaaataagtaattacctgaccacaaatcgccatgtaacaggcttggttttaccgtgtgcatgtgggaatcttgcaacagttgttgtcgtaagcggtgataatgcatttcacgcgtttctgaccataaatggtgttccttagccaaattgactaatacatctaaacgttgttgtgtatagaaagttgcccaatcagtctgccaatgattaattttcggtaacttgccagctgtgaagtcgtggtcaagaccaaattgggcgtggtgttgatggtgaactttggcgacagccgctcccagtgcggactgactgccagtcccggtcgctagccaatctaataagagataaccgtctgtggcaatcgtgccactggcgatgacacgcggtgtcttagtcactgcaccaagtagtcgcaatccagcgacttcgtggtcaaagaaagtaacgtcgttgtgcggctgaaccttcaaaaaatattggtgatgacgggtgatgatttgaaaggccgcgttgatgtcgccaccgctcactggttgcacttgctgaatgtcagtgagtggtagttgtgcgagccaagtttttgttaagtgcatgttaactcctccttgctgcgatgttaaatacggttaccatcactgtaacgcaattaattgttattaacaattagtggcgttgatccgtaagagtgtgaaatgaggttagacgtccggtacggagctaaagtgcaggcaaatagacggttatttaggtaaaccgcgtcagttgatatgcgattcatcgattgaatagtcgcgaaaagtggccgttatcccagtcactggaataacggccactttcaaagacttcatgctgactgcattattattgattggcgaagtaggtactcaatccggcgtaaaccgcgtgcgctacttcttgagggtactttttagaactgatcgtcttgaagtccgacttatcattaatataacccagttccatcaatacggatggtcgtgaattatcacgaatgaccagaaagtcaccgaagtccgttcctttactaggaattggcaaggtcgagacgttattgtttaacgccttggctagtgctagtgaggttgacttatgatagtaataggtcgtgatcccagaagccgtgtttttttctggtgagctgtcaaagtggaagctgatgaaggcgtctgcatgaagcttgtttgcgattgcgggacgcgcactcaggccgacgtattcatctgaatcacgggttaaaacaacgtgtgcgccagcagcccggagctttttagctacagctttagcgacccgtaacgtgtacgttttttccatctggcccttgctcgagagcgccccggaatcagaaccgccgtgtccgggatctaaaacgatggtggcttcagagattttggtggttttagtcaactgactgttatgttcgttgactaaccaactagcaatccagccgaatttatgatccgcataacggacgtatagccaattatttttgcgtttcataatgtggaccttggtgcccttagacgtagcgtcctcgatcgcataactcatgcctggaccgctacgaatattgacgttggcaatgttaacagtcgcagtgttattagtcgctaatagcactacaaagccaatcactaggccgataaaaataaccgtgactgtgatttgacgccaaaattgttttaaaacttgcatgctctgtcaccaactagatttaagataattgcaatttgaagtgctgcaaatagtataccaaaaaaacagctgaccgacgaaatcttgagataattttaactagaatcgttgacttttaagtgattttcgtgtaactttaaccatatattaatcaatcgaccgcagagaaagtaagagcattgtacgccactataaccagagaccggtagtgctgagaattccggatagtgcgcaatgaggagacgcttttgaggtgaacggcagcgttccgcctgtgattacagacgttatcaattagtactcaaaaaggtggtaccgcgctaatagcgcccttggtaaataatcaagggcgctttttttgtcgattgcaatcaagggaggaactattaatgagatatcaacggcctaaaggcaccgccgacattttgcctggcgatagtgaaaagtggcaatacgttgaagcaacggctcgtgccgtcttcaagacttatcaattcaaagagatccggacaccgatgtttgaaaatttcgaggtcttctcacgttcagcgggggatacttctgatattgtgacgaaggaaatgtacgattttcatgacaagggtgaccggcacattacgctccgcccagaaggaactgccggcgtcgtccgggcgttcgttgaaaataagttgtacggtccgcaagttctcaaaccatacaaggtttattacatgggaccaatgttccgttatgaacggccccaatcaggtcggttacgtgagttccatcaattaggcgtggaagcttttggtagtgaaagtgctgccctagacgttgaagtaattgcaatgggctataacttacttaaaacctttggcttgactgatttgaaactggtcatcaacacgttgggtgatcaacaaacgcgtgatgattaccgacaagccttgattgattatttggaaccacactttgatgaattgagtgatgactccaaggaacggttacacaagaatccattgcgggttttagatagtaaggcaccggaagatcaacaatttgtggccgatgcaccatcgattttagattacttgtctccggaagctcaagcgcattttgatcaaactaagacgtatttagatgcattagcaattccgtacgagattgatgccacgatggtccggggattagattattataaccatacgatttttgaaattatgacccactcaaaagcgttaggcaagggctacacgacgatctgtgctgggggtcgttacaacggattggttaaggaattaggtggccctgaagtttcgggtgttggctttggcctgggtgttgaacgactattagtgttgatggatgctgaaaacattgcggtaccaactgatgatcagttggacgtctatgttgtgggaattggcgacactgctagtgctacgactttgaagctggtacaggcattacgggcagccggttataaggccgaacgggattacttggatcgcaagcctaaagctcagttcaagagtgctgatcgcttgaatgcccgttacacgatgacggtgggcgaaaccgagctggctgatcaggtcgttaacttgaaggctatggctactggtgaggaaaccaaggttgcgatggcggacatctatcaagatgctcatcaagttttagataagtagtgtaaacggcaagtttgccgatttataaggaggaagcgtttatgaaacggaccacatatgcgggtctcatcaatgaggattatttaggccaaacggtcactttacaaggttgggtacaaaaacgccgcgaccttgggagtttgatttttattgatttacgggaccgtgaaggaattgtgcaattagtctttagtcaggaattttcagcggatgctttggcggtagcagatcagttacggggcgaatacgtcattgaagtgcaaggaaccgttgttaatcggaatgctgacgctgttaatgaccgcatgaagactggtaaagttgaagttgagattcacgatgccaaaatcttaaataaggcgaaaaccccgccattttatattcaagatgacattaacgtatcagatgaattgcgcttgaagtaccgttacttggacttgcgtcggccagaaatgcaacgtggattgaaaattcgtaatggcatcacccaagcagttcatagctattttgatgccaacgggttctatgatattgaaacgccgttcttaacgaagtcgacgccagaaggggcccgggattacttagtgccttcgcgggtctatcaagggcatttttacgcgttaccacaatcaccacaactctttaagcaattgctgatgggggccggttttgatcgctactatcaaattgcacgctgtttccgtgatgaagatttgcggggtgaccgtcagcctgaatttacccagattgatatggagacatccttcttaacggctgaggaaattcagtcctatactgaaggcttgattaagcaagtcatgaaggacgtcaagggtgttgacatcaagacgccgtttacgcggatgacttggcaagaagctatggaccgttttggttctgaaaagccggatgtgcgctttggtatggaactcaaagacatgggcgcggccgtttctaacgccggttttaaagtctttgataatgcactcgctaatggtggcctggtcaaggcgattgcagttcctggcggtgctgatcaatattctagaaagcaaatcgatgcgtacacggagtacgttaaacggtttggggctaagggcttagcttggatgaaggtcactgacgacggctttagtggtcccgttgcgaaattcttcaagaacgatggtgactttgaagccattacgagtgctgctgctgctaaaccaggcgacttattattgtttgctgccgacagtttcaaagtagtttctgacacgctgggttacttacggaccgcgattgctaaggaacttgacttgattgatcaagatcaatacgcttacctatgggtcgttgactggccattgtttgaatatgatgaaggcatcgagcgctgggtaccagctcaccatccattcacaatgcccaatgaagaagatgttcattacttgaatgatggcgaagatccacacaaagcccatgcacaatcatatgatatcatcttgaatggttatgaactcgggggcgggtcgatccggattcatacccgcgaattacaagaaaagatgttcaaggcattggacttcactaaggaacgagcccaagaacaatttgggttcttactggatgcccttgacatgggctttccgcctcatggtggcttagcaatcgggttagaccggttcgcgatgttattatcaggtaatgacaacattcgtgaagtgatcgccttccctaagaattccaaggcgtcagaaccaatgaccaatgcaccatcgcgggtttctgaccagcaattagctgatttggatttgaatattaccaatcccgtaacggatgatgaaccaaccgaataaaaatattaagagcgtccagaaatggacgttctttttaattagtgttaaatttatattaatatttaattggaggaattctcatggaaacagcaatttttgcgggtggatgtttttggtgcatggttcagccttttgatagtcaacccggaatcgacagtgttgtctcgggttatactggtggacacacgaaaaatcccacttacgaagacgtcaaagcgcatacgacgggtcatactgaagctgtcaaaattacgtttgatcccgatatcattagttacacggaattagtcaatatttattggcatcaaacggatcctaccgatgcaatggggcaatttcaagatcgtggtgataattatcggccggtcatttttgtgaatggtccggaacaacggcggatcgcggaagcgtctaaacgggcattacaggtgagcgaacgatttagtaaaccaatcgtaacggcgattgagaatgccaaaccattttatccagccgaggcacgccaccaacgcttttataaaaataatccagtggtatttgcggaacaagaagcgggtggccgcgctgatttcatcgccgagcagtgggccgatgcacctaaagtggactaagcgtgagttgctggtcatcgcgataggtgtgatctaataataactatcgtagcggggctcgttctggaaattagtcggattgattaatgggagtttgctgagaaacgtgagacttttagcagaatactgcaaaagaccggccgtttgcaaatcggcgtgttacaataacgaaagcaaaaacgtaaaggagcacacttaattcatggatgattttcagcagttatccaaacaccatcgtgatgttgtgaaagcgtcaactgcttttatatacgccattttagtttccattgccatgaactacttttggacgccggggcatatttattcttcagggatcactgggcttgcgcaattgatcaatagtttgatgagcaagtttcttcccgttcagatttcaactgcggcgttactgtttattttgaatgttccaatgttcattattgcgtggcgatcgattgggcataagtttacgttgtatacgttcttagctgttacgctatctagtattatgatcaaactgattgccccagttggcttgacccatgaccccatcatttgtgcgatttttgggggtgctgttaatggtttcgggaccggaacggccctcaaaaatgggatttcaaccggtggcctcgatattatcggtatcgtgttacgccgtaaaacgggtcgcagtattgggacgatcaacatggcgttcaactcgatcattgtcattgcggctggctttgtttacgggtggccatatgccttttattccgcactcgggttgtttgtaaatggtcgggtcatggatatgacgtatacgcgccaacagaagatgcaagtgatgattattacgagtcgccctaaaacggtgattgatagcgttcaaaatcggattcgtcgtggcgttaccatcgtacacaacgctgaaggtgcttatcaacatgatgataaaacgattttatttacagtcatcacgcgttacgaaatgggcgaattgaaggcggccatggccgaatctgacccgcacgctttcgttagtatttcagatacggtcaagattctcggtcacttttatgaaccgaagccttgatgaatttatcagattaaaagtgtttgcaaacaggactttcgggacttgtttgcaagcactttttgattaggcgttcggggacgacttttacaccactattaatagtgacccgactagccgaagtgtgggcatctgttatataatacaagcattgtgttattgctggatcataagtccatatcagttagacccagagctaatgaacaactaatggggaacagacttgaaaaatagttgtttatatttagtggacgaaggcagacggctcaagtaagttgacgccaatctgaactttttaagcgtaattgagctggcacatttttgattgtcacgtagggcacgctttaccaataattaatgatgaaatgaaaggatggccagtgtgaagaaagtaatttatgtctggctggtgcgagttgtatcgtggctagcgcactttagcaaaaatgatcaggtgatttatttgatgagctttgcggacaatttggattttattcagcagttgaaccagcgcgttcccgggcgcttgactgtttattacttgccgagtgcagccaccggggcggcacaactggcacaggcgggaattgcgacacggccgtttcatgattcagttcgatttgccttgacgggaattcccgtcattacccgggcagcggacgtttatcttgataattattatggctttaccgctggcttgacgcggcaggccccacaacgactgattcaactctggcatgctgctggcgcggtcaaaacatttggttggggtgatccacagacggcacagcgacccgcagatgatcggcgtcggtttcagaccgtgtatgatcagattactgattacgtggttggttctgagaagatgggaacgatttttgcagcgagttatcacgtcccacagacgcggatgcgggtcttgggatatcctcgttcggatcggtattgtaagtccgactgggtgatgcaaactgcaacggccatttatcagaagtatccggcgtttaaacaacaggaagttattttgtatgcgccgacttatcgagccggtgttcaatttgcgttgccggctgattttaagcaattaaagttgcggcccgaccaacacttgattattaagttacatccccatttggccgagcaggaacgtgatttgcaagcccgttacccggacctagtgacattggtacctgagtttagtaccgatgaattgttgacggtcgctaatacgttggtcagtgactactcctcagttgtgtttgactacgcgttgttaccaaattgtcaaaaaatcgttttttatgtctttgactgggaccactatgagcaagaagtgggcctgcaagctgattttagggactgggcgccgggaccattagtccggacggtggtggacttgaatcatgtcctagcaatgccgggtgcgccgttacagttaacccagtttaatcagttatggaatacgcgtaatgacggtcatgcgattgagcggaccttggcgtacttttatccacgggtgaccacaaccgcttagaataacttgacagatttatttggataatgagtgatcatgccggtatcatatgtatccggcaactttaaggtatgacaggaattagtaaacttgcgaaaaggatgggactacaatgcttagattaggttcacatgtttcgatgaaggcacccgacatgttgctcggatctgccaatgaggcggcaagttacggcgccaacacatttatgatctatacgggcgcaccccaaaatacacggcgtaaaccaattgacgaactgaaaattgacgaagcacagccgataatcgaggctcatgacctccggcagatcgtcgtacatgccccatacatcattaatttaggtaatacgaaaaagccgggttattttgagtttgcaacggactttctctatcaagagatccagcgtgcagatgccgttggcgcaacacaattaacgctccatccgggagcacatattggtgccggagcggatgttgccattgcgcagatcatcaagggactgaacgcggttattcggccagagcagcacgttcaaatcgcgctagaaacgatggctggcaaaggaactgaagttggccggacgtttgaagaactcgcacagatgatcgacggggtgacttataatgaaaagttatcggttacctttgatacttgccatactagtgatgccggttacgcgattaaggacgatttcgacggtgtcctgaatgaatttgatcatgtgattgggctggatcgtttgaaagtgatccatctcaatgattctaagaatcctcaaggtgctcacaaggaccggcacacgaatatcggtatgggaacgattggctttgatactttgaataaggtcgcccatcatccacaattgccagacatcagcaagattttagaaacgccgtatgtcggggaagataagaaacatcaattgccaccttataagtatgagattgcaatgcttcgggccggggagtttaatccgcatttgattgaagatattgaacagcaacgttaatgagaattgaacgataatcgctagtcggttgtcgttttttgttttagaaggaggaaaatgacgatgcaattgaaaaaacagcggctattagtgattggtggtacttcgggtttcggcatggcaattgctcgccaagccttacaggaaggcgccgatgtccatattatcggtcatacggcggcgcacgtaacagctgccatcacccaattaggcccatcagaccatttgactggaacggcgttagacgcacaaaatctggcgcaactaaaaactttttttgcagctcagcccgcatttgaccacgtcgtctcaatgttaggtggtgcaatgggtggggggttcttggacaattcgattgcagcgattcggcagacggttgaagataaattttttgcaaatctgcaagtggcccaattagccagccaccatcttaaccaacacggttcgctgatttttacttcgggtgctggtgggcggccagataatgcctccggagcgattgttggcaatcaagccattaatacgatggtcgttggacttgccgtagagttggcgcctgactatcgcgtcaatgcagttgcaccgacttggacgccgactggtctttggcgccaactatcggacgcacaattggcagcccaggctgcgaccgtcagtgctggtaatcccttgaaacgcgtggcaacgcccgccgaagtcgcgtcggcgtatgtttatttgatgcaaaatgagtttatgactgggcaagtgttgcacgttgacggtggtgtcgagctcgtgtgagtgacacgactgatgattagtagctgacctaattaatgataagaaaaatgatgcaaaaaagcgcgcgctgaccgttagaaggtggcacgcgctgattgtcaggaaaacttaggcggcatcggtgagttggcgattagtgatactagccattattagtgtcgtcagtattcaagctttcggtaattaaagtggcggtttcttcgattgacttattagcgacattgataactaaacacccaatctttttgaagatcttgtcggcgtattccaactcggctttaattttatccgtgttggaatacatggtgtcgggattaagcccatattggaccattcgctgccggcgaatatcgtttaacttttcaggatcgttagttaggccaaaaatctttttcggatcaactttccaaatttcgtcaggaatttgagcctgaggaactagtggcaagttggcgactttcaggttacgattagctaagtagagtgacaggggagtcttagaggtccgggagacacccagtaagaccacgtcggcctctaaaaagccactcggattcttaccatcatcgtaagtgaccgcaaattcgatcgcgttgatccggtcgaagtagttggtgtttaacgcgtgtacggtaccggggtgattggacggttggacgtgcgtaatctgtgaaaaagtatctaaagctggtgtaatgacgtcataataaggcaactcgtgcgcttcgcaaaattggttaacgatttggctgagccggcgatcgacaaacgtatgaaagatggcggcgtgttccttcagtgcctgcgacaaaaccgtctggagcagtgagtcggtgcggacaaatgggaaacgctgatagcgaatgtcatagtcggagaattgtgcagcggcagctaaggccacgttatgagctgtttcaccgatagaatcagataaaataaagactttaattgctgacatagaataacctcatttcggttcgataatagtcttagtgtagcatagccggcgggggatgaaaacgatttactgtccgaactgacgttgcttttaacgatttattttaaggaaattgtaaactttggttgacggcctttttcaatttatgtataatttactagaacagttgcgttatgtgtaagtatgcataatttaacggttactttttgagctcggagggagggaatttaacatggcaaaaacagtcgttcgtaaaaacgaatctcttgatgatgctcttcgtcgctttaagcgtaccgtttcaaagagtggtactttacaagaataccgcaaacgggaattctacgaaaaaccaagtgtgaagaagaagttaaaatctgaagcagcacgtaagcgtaagaaccgtcgtcgtttcaagtaattagtattgattactaatgacctaacgaggagggaaaaccaatgagtttaatcgatacactcaatggtgatctaaaagctgcgatgaaggcacgcgataagcaagccctcagcgttatacggatgcttaagtcagcattgatgaatgaacaaattaatgttggccatgatttaacggctgatgaggaagtaagcgtgctctcacgtgaactgaaacaacggcgcgaatcattaagtgaattcgaaaatgcgggtcgtcaagatttagtcgacggcgttaaagcagaaattgcaattgttgagcagtacatgccaaaacaattgtcggacgaagaagttcaacagattgttgctgacaccattcaacaagtcggagctactggtaaaggtgactttggcaaggtgatgggggcagtgatgccaaaacttaagggtcaggcggatggcaagctgatcaaccaaacagttaaatcattattgaattaacggttaaccggagaaatttttctccggtttttttgtttcttctggttgatcagaaatgcagtaccggttgttcggattaagtataagcaatgggtgcagggactgatctaactgggcttacgttgattgatagcgtgccaatttaatcgctcgaaagaaaaatgctgttcagaaaatcgttgtcgaatgtcgaggcgtccttgtactggttcgatgggggcttttatgctatgattaactaacaaatacctgctgaaatcagcgtggttatcacgctacctgcgggtgccattattaaataatggtgattaaatctgtcaataaaggagtccatgtttttgaccgaaaactcaaaatatgaacaaaaatttctcattgctgatccggcccagtcagtcgcgttattaggaccagaagacgcccacttagctttgattgaggatgggttacacgttcaattgcacgtgtttggggatcaaatgacgatcagcagtgatgacgaggttgctgttcataatacgcaagcagtactagataatttaacgagtttaattaaacaaggtattcagattggggcgccagatgttattagcgctattaagatggtcaaccgggggactttggattactttaaagacctctattcagagaccttaattaaggacaatcgtggacggcccattcgtgtcaaaaactttggtcagcggcagtatgtgcaagccgttgctaaaagtgatattacgtttggtattggtccagccgggactgggaagacctatcttgccgttgtgatggcaattgcagccttaaaacggggcgatgtcgagaagctgattttgacgcggccagcggttgaagctggtgagagtcttggctttctacctggtgatttaaaggaaaaagtcgatccgtacctgcggccaatttatgatgcgttgtacgatatttatggcgctgaacatacgcagcgcttaatggatcgtggtatcatcgaaatcgcaccgctggcttatatgcggggacggacgcttgaccatgcgttcgtcatcttggatgaagcacagaatacgacgaatgcccagatgaagatgtttttgacgcggctaggtttcggtgccaagatgattgttaatggtgatatctcacaaattgatttaccacaccatactaagagtggcttgattcaagccgaacagattttgggcggcattagcaatgtcgcgttcgttaaatttacggcggatgatgtggtcagaaatccggtcgttgccaagattattacggcgtacgaccgtgtggaacaacgctagggggcacttatggatttagaattatacgaccaaacaacaacgggagcgcagccagaacagttgcaattgattcgggatttaattgatcttgctggtcagacgttaaagttacgggatgataccgaggtctcggtgaccctgatgaataacgatgctattcaaaaaatcaatgaacagtatcggggtgtcgatcgtccaactgatgttattagttttgcgatgcacgacgatgacgaggatgatttgattgtgatggatccggagatggcggcggaaatgccactaaatctcggggatattatgatatcagttgataaggttagcgaacaagccgcttttttgaaccattcggaggcgcgcgagctaggttacttggtcgttcacggctttttacatttaaatgggtatgatcatcttcagccagcggatgaaaccgaaatgtttacattgcaacgccagattctggacgcttatggcctcgaaaaatagaccagatcggctacaggttggcaaaaatcactcgttttggcagtcctggctacacgcgtggactgggcttaaaacggttgtgattgaagaacgtaatatgcgaacacaccttgtactgggggcggtggccttgtttgctggctggtgggttcacttgagcgttaacgaatggctgtggctagcattagcgatttttctggtcatcttatgtgaaattaacaatacgattgcagaaaacctgtccgatatgatcactgggcctaatttcagtcccctagctaaaaaaattaaggacattgcggctggtgcggtagtgtttgccgcggcctttgccgtcttagttgggttagtgttgtttgcacctaaaatttggaacttaattgtcagttggttaaactagtaattggttaacgattggacaagattgaaaggaattaattatggcagaacaacaagcatttcattccggctttgtggcgattattggtcgtcccaatgtcggtaaatcaacactattgaatcgggtcgttgggcaaaaagtcgccattatgtctgacaaagcccaaacgacgcggaaccgtatccaggggatttataccactgcggatacgcagatggtcttcattgatacccctgggattcataaaccgcatagtcgattaggtgactttatggtcaagtccgccttgtcaactttgggtgaagtggatgccgtactattcatgattaatgcggacgaacggcgtggtgccggggataactttattatcgatcgtcttaaaacggttaaacaaccgatttatttagtgattaataaaattgatcaagtccatccagatcatctcttggagattatggatcagtataaagacgctttgccgtggaaggaagtttatccaatttccgcgcttgaaggaaataacgttgatgaactactgacgaccttgaagggccaattgccggaaggaccgcagtattatccgtccgaccaaattacggatcatccagagcggtttatcatttctgaattgattcgtgaaaaggttcttgaattgactcgtcaagaagttccccattcaacggcggtcgtgattgattcgatcaaacgtcaagatgaagaaaaaattcacgttcaggccacgattattattgaacgatcttcgcaaaagggcatcatcatcggtaagggtggtagcatgctcaagaagattggctcgttagctcggcgtgatattgaacacttacttggggataaggtctaccttgagctctgggtaaaagtccaagagaactggaaggaccgtcaagacttgctagccagctatggctatcggcaagatgactattagaatcgctaggtgatccggatggcccaacaaatggtcacgaattttaacggcattttgctctttcgccgggactaccgggaacgcgatatgctaatcaagtttttaactgccgagtatggcaagaagatgttttttatccgcggtgcgcgtcggcgtggcttcaaaatggcggcggagttattgccgttcacgatgggggaatacgttggtgatttacgtgatcaaggtctctcgtatattaatagtgtcaagtcagtgcagtatcttgaacatattagtcaagacattgctttgaacgcttatgccacgtacgttatgaacttaatggacgtcgcttttccagataatcaaccggtggggcggtggtaccaacagttgaccagtgcgctgcaactgattgatcaagatgtggcccccgcgttggtggctaacgtggtcgaaattcagttactgcaaccgtttggggtggccccagagttgcgttggtgtacggtttgcggtcgaagtgatttaccgttagattattctgaaagttacggcggtttgctctgtcaacagcactggcatttggatccccaccgcttgcatgctagtccagcagcgatcttttatctacgtcagttttccgtgttggatttggctaaggttcattcgatcaaggtcaaaccgcggacagcggcggagttacgccggattttggatgaaatctatcagaactcagtgggcgttcgattgaaatctaaacgcttcatcgatcagatgggcagttggtaccaaccgttggcgccccggaagaatgaggattgacaaacgaacgaccatcggctatgatgatgaagaactgaatagttaagtgttgatgagagaaggttaacggattcgacttacagtgagaccgtgatggtgaaaaacggtcagtcaaagtcgttaattggcgctttcggagctttaataccgtgtaattaagctgctgaggttactcagaagtagggtggaaccgcgaaaccaatcgtccctatgtcgttattgtcgacgacaggggactttttttgtgccataagtctgggaatagcgatgcccccgtttcaaagccatcagccgttcagtcactaattttgggaggatactaatgagcaaaaagttatcagtgcaagagattatcttaaccttgcaaaagttttggtcggatcaaggttgtatgttaatgcaatcatatgatacagaaaaaggggccggaacgatgagcccctacacgttcttacgggcaatcggtcccgaaccatggaacgcggcgtacgttgaaccttcacgccggcctgccgatggtcggtatggtgagaaccccaaccggttgtaccaacaccaccaattccaagtggtcatgaaaccctcaccagaaaacgtgcaggatttatacttacaaagcttggaaaaacttggcattaacccgctagaacacgatattcgtttcgtggaagataactgggaaaacccatcaatgggttgtgccggtgttggttgggaagtttggctcgacgggatggaaatcagccaattcacgtacttccaacaagttggtggtcttgaagttgatcccgtcacttctgaaatcacctatggtttggaacgactctcatcttacattcaggatgtaaactccgtatttgaccttgaatggggcgatggcgtgaagtatggcgacatcttcttggaaccagaatttgaaaattctaagtacgcttttgaagatagcaacgaagaattattattaatgttatttgatgaatatgaaaaggaagccaagcggcaaattaagaacggcttagttcaccccgcgtacgactactgtcttaaatgtagtcataccttcaacttgatggatgctcgcggtatggtttcagtcacggaacgtgccggctatttagatcgaatccgaaacatggcgaagtcgattgccaaggaattcgtggcgcaacgtgaaaaacgtggcttcccgttattaaaacacgcacaggaggagacgaaataatggcgaaaacttatttacttgaaattggtttggaagaaatgccggcccacgtcgttacaccgagtgtgttacaacttaaagaacgaatggtcaagttcttaaaggatgcccggcttgattttgaagatgttaaaaccttctcaacaccacgccggttaacggttcaggtgttaggcttagctgacaagcaggctgatgtgaaaaaagaagttcggggtccagctaagaagattgctcaggatgcggatggcaactggacaaaggcagcgattggtttttctaagggccaaggggcgtcaactgatgacatcgtctttaaagatgttaagggtaccccgtatgtctttgtacaaacctttacggccggtaaaacggcggccgaagtattggcggccggaatcgaggatgttatcaccaagatgaatttcccaacgatgatgaagtggtcgacgtatagtttcaagtatattcggccgattcgttggatcgtgtcattattaaatgacgaggttgtgccggttcaaattctggacgttgcggctggccgtgtttcacgaggccaccgtttcttgggccatgacgttgaaattgctactgctgcggactatgaagctgacttagctagtgttcaagttattgcggatgccgctaaacgtaaggcaacgattcgtgaacagatcgcagccttggcgaatgaacgcgactggcaaatcaaagttaatgaagacctgttggaagaagttaataacttggtggaatatccaactgcatttgcgggagattttgataccaaatacttaacgatcccggatgaagtcttgattacttcgatgcgtgatcatcaacggttcttctacgtaacggatgccgaggataacttattaccacactttgtttccgttcgaaacgggaacacggatcacttggaaaacgtggctttaggtaatcaaaaagtattgacggcacgcttagaagatgcagctttcttctatcatgaagatcaacaacactcgattcaagaatatgtggaacgactcaaaaaggttagcttccatgataaaatcgggacgatgtatgagaagatgcagcgggtcatggttatcagtgattttttggctgatcggtttggtttgactgagactgaaaagaaccaactccaccgggcagcgcaaatctataaatttgatttagtgacagggatggttggcgaattccctgaattacaaggggtcatgggtgacaagtatgctgtcttgaagggtgaagatccagcagtcggtcaagctattcgtgagcattacatgccaatcagcgctgatggcgacttacctaagtccaaggtcggcgcggtgttagctattgcggacaaagttgattccattacgagcttctttgccgttggcttgactcctagtggctctaatgatccgtttgctttgcgtcgtcaagcgtttggaatcgtacggatcgtacgggaacaaggttgggatttcccaattcgtcaactcgaggccgatattcaaaaggaattagtggcccatgatgctacgtacaacttagacttcgaaaagcaaacggcaccagttgctgatttcttaacggatcgcgtcaaacaatggtttaacaaccgtaagattcgctacgatatcatcgatacggttatcaaagggagtcgtcaggatatccgtgaaatgttcaaagcagccgatgtgctgaatgcgcatcaagatgatccgcagtttaaggacacaattgaagcctttactcgtctgttgcggatcacggcgaaagctaagttggcagccggtgatttgactgttgatccaagtttatttgaaaatgaggcggaacaacacttgtacgatgctgttcttgaattgcaaaagcaatttaccccagcgatgagtatggaggaccgtttcaaagccctggccgccttacgaccattgatcgtcgactactttgaacagacgatggtgatgagtaaggatgaaaaggtgcgggataatcacttgaagcaactcttgacgatcgcccaaatgatcaacgtgatgggtgacttgaatcaattaatcgttaaataagcacggactgtggataatcaaaagaagttacagcaagcgcgctgtagcttcttttttagtttgctgacaaacaaatttgacaaatatgtctaataagggcaacttattattgcactgctgtcaaacttgtggtagtatatattctgtaaaagtttgcacgcacaaagtcgcatccaaatttcgtgatgcggcttttgattgcggcaatgatttggttggtttgtcagactttagttagtagaaatggggtggcaaagtggccaatcgaattcccgaggaaaaggttgagcaagtccgctcagcagtcaacattgcggattttattggacaatacgttcagttgaagaaggctggtaagaatttatttggcctgtgtccctttcacgaagagcgcacgccatccttttcggtcaatgagcaaaagcagatttttcactgtttcagctgtggccgtgggggcaacgtgttcagcttcattatggatctcgaaaacttgtcttttccggaagcagtcgtcaaggtggccgattttgggcacattgacttgccggcgagctatacggcgcagtcacaaccggccgcacctaaggatcagcaacaagccgatctgttaaagttgtacgcggatagcgctaaaatgtatcaacatattttagtgaatactgaactgggtgaaccggcgcttaagtacttgcacgagcgtgggctggatgatgagacgattaaaacgtttggtatcggctatgcacctgctaatcagctcttgttagatttttttaaagaacaccagtccgactaccaactactacggcagtcgggtctgttcattgaaaatcaagcgggtgacttacgtgatcgcttcgttgaccgggtcttgtttccgattaaagacgcgagtggtcgggtgattgctttctcaggtcgaatcctcaaaaaatcacctaatgaacctaagtatttgaatagtccggaaacgaagctgttcaacaagcgttcagtattatttaactttgacttagcacggggccccattcgacaacaaaagtcggtggttctgtttgaaggctttatggatgtgattgcggcttatcgttctggtattcagaacggggtcgcatcaatggggacgagcttaactgatgagcagatttacatgcttgagcgcgttaccgacaccttatatgtctgttacgatagcgatatgccggggcaaaaggcgactgatcgtgctctgaaattgctaggtggcaacagtcgccttaatctgggtgtaatccaaatgcctgatgggatggatcccgacgagtatttgcgtgctcaggggcaggagaagtttgtccaagtatttgaagatggtaagcaaacgcccactgcatttgaaatgcagtatttaaaacatgatttgaacttgcaaaacacgcccgatcaattgacttatttacaggcggtcttgcaacaattagcacaactgtcctctagtgtcgaacaggatttatatttaaaccaattagtggcggagttcgatcttgataaggatgatttaaagcaacagttacgatcactggtcggtcagcaggccgttcgacgtggtggtggtcactcggatgaaccgcaagtagctccgccaccagcacctgcgccgctagggccacccccagccacggtggatggcagtacgaacagtggcccgttaagtcgggtagagaaagcggagcggttgttactgtaccgtttgttgaatgaccacgatgtttggttacgggtgatggcgattgctggttttcattttgttcatgattcgtatcaacaaatcttggtgtatgcggaggcttattttaaaacgcataatcaatttgatttgggcaactttacggattttatgacggattcagatttacagcctgtcgtcacgagtttggaatttatggacgtggccaatgaatcttccaaggaagagattgctgatctagtcaatgtgatcatgaatcaacagccgctggtagaacaaatcaacagtaagaaggccgagttaacggcagccaagcagatcggtaatcgtgatttggttcagcagttaacgttggcattaattgacctatatcggcaacaacagcaggtccaacgagctgataactaggcgtgaaaatgatatacttaaggttggctcggtattgcaaccgatcagctggtagatgcatactaaataggaggctactacatggcaaaggcaaaagcaacgacggaatacgacaaagccgttaaagcattaattaaggaatataagaaaactggtagcattcaatatgatgaattatcagataaattagcagcgccttacaaactagatgctagtggcattgataaattattacaaaaggttgaagatgctgggattagtgttgttgatgaaaaaggtgatcctgatgctcgagcggtcaaaagtgtcaaaaaagtttctaagaaggaacttagtgacgctggctcggcttctggaattaaaatcaatgatcccgtgcggatgtatttgaaagaaattggtcgtgtcgacttgttaacggctgacgaagaagtcgctttagcactccgaatcgaacaaggtgatgaatctgccaagcaagaattagccgaagccaacttacggttggtcgtttcgattgccaaacgttacgtgggtcggggaatgcaattccttgatttgattcaagaaggtaacatggggctaatgaaggccgttgaaaagtttgattaccgtaaaggattcaagttctcaacgtacgcgacttggtggattcgccaagcaattacgcgggcaattgccgaccaagcgcggaccattcggattccagtgcacatggtcgaaaccattaacaaattaattcgaattcaacggcaactgttacaagatttagggcgcgaaccaactcctgaagaaattggggctgaaatggacatgccaacggaaaaggttcgtgaaatcttgaagatcgcacaagaacccgtttcattggaaacgccaattggtgaagaggacgattcacacttaggtgacttcatcgaagaccaagacgcaacctcaccagcggatgccgcggcttatgaattgttgaaagaacaactggaaggtgtccttgataccttgacggaccgggaagaaaacgtcttacgcttacggttcggacttgatgatggtcggacccggacactggaagaagttggaaaagtcttcggtgtgacccgtgaacggatccgccaaatcgaagccaaggcgctacggaagttacgccacccatcacgtagtaaacagttaaaagatttcttggaataatcaccagatgatgacgtctgactaaccagctaaaggtgctgattggtcaggcgtttttttttgcttatgtagatgttaaaacgtggtggacactgatttaagccgcaacccacgtcttaatgccatattgacgaaacgtgttcgggtccgatgagccttccgggtagcgacacgatgagtttaccgcttaacgccttagttgggctaatcctcagtctcaagccgtctgaaccacacactctggcagtgctgagcattggccgaaatgccttccagttgggaaggtattcgaatggctgacagggatgtccccaacttttgctggcttggtcgttgctattttagagacagcaattttatcagtaactgtcagtttgataatcgaactgtgattcgttcattaattctcagtcaccatattatgactgagattccaaacaactgagaccacattaacgtttgttcaatgttccaagcagtaattgaattcggcgaccaattgcactaagttgagtggccgttcatctgtcatgcgagcaggggtcccggaggtcggaataggatgaacaagcactgatgaactggcaaccaaatttaagactcttttcagtaatttggcatactgtaatgatgtcgcactcacgtttgaggtaatcattttgtgccaggaatatgattgttgagttgtcaaactcaaattagtgtgttattgtactagttgtagtaatacacgtagtacacaataccgaggtgataaaatgccgtttgcaactaatggggcaccgtattacgaacagttagttatgcagattaagcagcagatcgttcaggaagtcttacgaccaggggatcaattgccttcaattcgagcaatggcgtcagaaatgcaccttaatccgaacacggtcagtaaggcttatcaaatcttggagcatcagcgagccgtgtatactgtaaaaggtcgggggacgtttgtgagtgaatcgagtcagattgcaattgattcgaatgcggttgatgatcttcagacgcgcttacaatcactgttaacggaagcacaatttttaggaatcagtgcgcagcaagttcaggcgtgggtgaccacggcttatcaaaagggggagtcacgggatgagtatccaagttaaagcattaagtaagcggattgataatcgtgaaatattaagggggattacttttacttggcagccaggtcgaatcgttgggttggtcgggcggaacggcgttggaaagacgacgctctttcggacgatggctgatcactatttggcggacgaaggcgaattagtgattgaggggcagtcgactttgcagcaaccatactgtcggcaaaaattattttatattgatacacaacgtcacttttttggtggtcaacggttgcgacagatcataacgacatacgcgttggcttacgatgactttgaccaatcgcaactaacagcgttattagcggccgagcatttatcaaccaaaagctactaccagcggttatcaaagggtcagcagatgttatttcaaatcttgctagcgttagcgagtcacgtgccatatattattttggatgagccgtttgatggtttggatatcatcgtgcgcgagcggattgtagcctatatggttgaggaggtcgccgaacacggcgtcagtttcttgatttcatcacataatcttgatgaacttgacggtttatgcgaccaagtgctgtttttgcaacatcatgaattagttgctgattacgacctagaaagtttacgggcaacggcccgcaagtttcagcttgtttttgcagataagcatataccagcggttgtgaaagagcatgggcagctgattaaagtttacggtcgggtcttagaagtgtactttgcggactacacgccgacaattgagacagcgctccaacaaaatcaaccattgatgatggccgtccagccgttgaccattacagatgttttccgagttaaattgggcgaccggcaagctgtttggggtggtgtgtagaatggcaactgtaaaattgagacggttatggtggcaacaaaatcggccttgggtgcgacttgtgacggcaacgtgtctgttagtgagcttattaatggcaattaatgtgacacatacttggcaggtggaacatgcccggagtgtacgtggtgaacggatcaatgctgcagattttgttaaacacccgaaagactataaagttgccggtcgtccggcggttagcctgcatgtttattatgaacatcttgaccagtttttttggcctggcgaatacacttctacggatcccaatcaggcagtgcgggcccaacaacccaaccgtttgtattatgttttgggactcgtcagcggtttgctgcttgcattctggggtcgtcgcacacaccgcttcgagtttatggctggtttaggtgttacgcgttggcaaatttggtggcaacagctgcggctcgggctgctattaatggtcaccgtttttgtaagtcaagtgatttattatggctggatcacggctgcaatcccccaagtttatcagcaataccgtaacggggccgccctcttgggaagtagtgtggcagtgacgatggtcagtgggtgcctaattatgcttgcttggctggtggggagctttaatcagcggttatggttagcaatcctgatcagcactctgacctggcgttgggcgtcgggaatgttaacgcggacaaatatgtggttgcggtggtttcacattcagtcgttgcctagtatccggttacatgttcactacggggtagcggcaatcatggcattagtgggcttgctgatgctactaggattaacttgggtggcctgtcgtcaatggtcagcggatatcaccacattgcggcaacaatcgctatttaatggggttatcgccagtgctttgattagtttgagtattggctcaacacttggggacatcctactactgcctttgatgggaacaattgcgccgtggtatgaattggtcggaatcgtgctgactatgatggcactgctcgtctatcgtgttggccgtcgttaccatcaactgggggaagttgtgagatgaataaaaaattggggcacttgattatttggcagcatgcgccacttctcattggtatgctgattttgtttatagcactgggggcgtggactggcttcagaatgaatcaacactggcaaatgctagatcagaatcatgacatgctaatttcaggtcttaaatacgaccaccggcggcaacagtatcaggatgtagatggcttagtagcaccttcgaaacagcagtacttgaatcaatatttacaagtttatcatgctgatcggcggggattattggcgaatttgcgcgttgggagtaatgttgaaccaaatgattttctatggggaatcagtattttagtgggcatagcactcattgccattccacgttaccggcatcagaatgagtggttacagagcttaggatttcgccgagcagctatttttggtgcgacgtttttgagctatagtttaacgacgatcattgcgtatagttcggcgaaattaatggttctgctggtgctggtacagaatattcccggaatttatttcgcgcaattcaattggtgggtctggggcggcaatgtaatcagtaccacgctcgttgcactgattttgatgaccgcttctgcattagtgttattggtcacgcctaacctggtaatggcaatgctcgtcggctatgcagtcgttaaaccaatcagttggtttgtattgatacggtcattcggtcaacctggtaattatttgttggcgttcctcaatcaacactggttgttgggtatcgcaattggatgtctagtctggggcttgggcgggatacttggtcggtatttgagcgcccagcaaatcacggagcgtgaccaccaagcgattttgttaccggcttggcgggtaccaatgctgatagggttgagcatcatactgactaaattgattaccgacgttatgctggcaccacagacgagttggtcatatgtagcagtagtttggtcagcaacattaattggtctgattgcttggatttatcaaccgcgctggagtcgctacttttggcaagttgtgcgacagttacgctaatatgatgaaattaacaattaatcgataaagcatccagccggtcagtaatcttatttgaccggctggatgcttttaaacgttacgggtttgaaaagaatagttggcaagcgttaagaataacagtagataggcgatataaccaatcgccagcgtggatagatttagtcgggttaattgttgtagttgtggtgtttggatttgctcgcctagattgatcatgttgagcggattccactttaaccagctgactttggcgtataaataaaaacaaagttgattgaaaatggtcacaataaagtacccaatgatgccggtcagaatggctggtgttgaactggtgaatagggtgcccaatagtaagacgacactcattaaaaatagtagggtcagtcctgttgatagcatgttcagaccccaagtgtgccaaattgtaccgtaattaggtaaccgccgaaagaagctcaacttcagtccgagactcatgagggtgctaaagccagataagccaatcatcagaccgagtatcgtgagccatttgctgactaagacttgggtccgcgaataactgcgataaagtagcgctcgtaacgtgccattttgccgttcattcgttaaataagtgctgccaattgtgattgccaaaaatagtagcggaataaagccgtagtcgttgtttacaaatgcatcatatggcgttagtagctgtgggtagtgagcggcatatatcgcaattatgaattgaaaaatcattataaatggaataaacagttgaatcacacgatggtgcattaattttcgattttcttgtcgtaacaatgtgaacattagattgacctccttagtggttgaccgttttcagcatggttaataaggatgattctaagtcttcagtgtggggttgaatccgctgtaactgaatctgattggtcaaaagtagttgcagtaatggattaagctgaaatccgggcgttattaagacacgaattggtgttgctgcaactaggtggtatccagcagaacgcaatagctgataagcccgttgatcttgattagttactaattcataagtggggcgctgttgggcaagaaacgctggcatgctcatattggcgatcagttgcccgtgatcaagaactaagacgtcattggcgacccgttgcagttcactcaggagatgacttgaaattaaaaaggtggtgccttgagcttgcgcccataaaattaaatcgcgtaattcttttgtggcctgtggatcaagaccattcatgggttcatctaagatgactagtgcgggctgattgagcaaagccaaggctacacccaatttttgccgcataccgagtgagtagtgtttcgttagtatatcggcaaatgcttgcatgctaagtgcttcaatgattttggtaacgcgtgctgtacgattggcaccggttgcgaacagtgagagttgttgccggccagtcaagaatgggtagagtccgggatattcaattagggcgcccacagcgcttaaagcttggtgatggcatggcgtaattgactgaccatttaaataaatctgaccagtaaaggaagtgagccctaagattgatttcatcagtgtcgttttgccggcaccatttgcaccaactaaggcgacgatatgccccttttgaatggtgaaggtcagggcttttaaaatgtgctggtgactgaagtattgatttaattgcgtgacggtcagtagtggtgtgttcatattggaatccccctaaaccttaagcggctaataataaccacttcaaggtattttacaaacaaagtatactattaatcacagtgtaatagtgtagtattacgctatttaatataatcttaattattacttgttgtactcgttattatttagcaataactatggttaaaacgtcttgattttaaaattcagcaactgccagcttggatcaaccggaaacagtttgagtttgcaccaattttcggtggattcttaccacgctaactggaggcataattatcagccattcgagtggttgaccgatgggagcggcagggtgacagtgctcagtagcccaagctgacgagcaggagtctgattgactgtcacgttttaatcatgattcatgtcggattaactaagtgcattaattattccattgatacataagtgctaatttgacaaactgacttaatctgacatactaattattagcgaaattaaaaacacggtctggtcggtagtccagacgcagcaacggctgtcagtaacctgccttccttggttgtccgaatttcgttagtgaaattaaggaggggttaatttgattaaccgatgcaaattaacggtgttttttgatcaacaattttatcagggtgtttttgagcgttggtcgacggacgggtatcaagtcgcccgagtgacctttgggacgcagaatcctagtgaaccccagattaggttgttaattcaagatcggtggtcaacgctgcaatggacgacggctagtgcggttgctcagcagcaattggttcgcgagtatcgtcgtgcggcacgacaatgtcgtcaacatcacgttcgattcaaaccgactagagcaatgcaaatgttgaagttagaacatcagcgtaacttggtaatgaagaagcggcagcagcgtcgtgcccgacatgaccatgctcagttgatacgagcaaagcggttggcaaaacatcgtgctcaacatcgtggccattagttgacgagacactcacttagctaattttagttaagtgagtgttttttgacagcatcaaaataaaatcaatcagttttgaaccgcttcgagatttgataccaatgattccgggctttgaggacggactactgattggtgccaatggggcgttaattgcagataatcggcaaatcaaaccagttgcatcaatacggtcgcatgatttacagctcgtgactgagatggttgctagcgattgagttatattgcggatggctgctgagattgtgcggctcaagtcgattttcaaccagcttgattctcgacacttgccacaaagagttggactgccgaaattggatgaagtgattaaagttatcttattgagggttgatgaagatgcagagtatgcgcttaagtacttaactgctggcaactgagatgttgatgactgttcagcataccacagaaggtaatcttgatttgattgctattagggtcaataaatggtccgcctgtaacgactggggatccagcgctaagtggcgtttggtagcgatgaaaatgatcgacaattactacaacatgtaataacgagcatgtgggtccaaagtaaatcaattaggagaataattaacggatagccgatgttcacctgcattagtggctgaaagaattcgggcactggcagactaacgaattggcgtgaacacaagccaaaaaacacgatcactagccagtgaccgtgtttttatttgataattctggaaattagttgttcgcgtcagcggctggtgtcatccaagcaacaaatcgatttgcatgttcggtaaagaaatttacgagtcgcccagttaaaaaggctgcaatgagggtaccttcccgaacccccgctaaagaatgagtaaagctgagtgccaggactagtgaaatgccaatcagaatgaaatcattataaactttgactttggcaaacttgagttgatgcatcagtgcgatggcgttcggaagtccttcaccaggcatgataatggcgtgtgaattgacttctaaaaagacacctaacgataagagcaccgttcccattaagacaagtccgagttgctcgatgtatgtttgattaggaagactatggaaaaaccgcacaaaagcatcgatgaaccaaccgaacaggctacccggaattaattgcaataagttttgccaggagaactgccggcgcaaaacgatggcttctagtagaactaaaatgaaaataaaagcaattgtcaactggccaattggaattgccgtaatattgctaatgacattcggaatacttgagattggggacgttcctaataaggataatttagagagtgcgacgccagctgacatgcacaggataccaattacgaggactccaaagtgtttaatgaattttttcaatgacgatttcaatctcttttctcttgtaaggcgaggtaaacttgttgtaattggtgcgtaaacacttgctcgttgacttctggatgagcagcgaagaagtcatgccaccagtcaatcaatgttttcttaatggcgatagcgatttgttcaccagccggtgtcaagctaattcgtagactacgctgatcggcaggatcacgaaaccggatgacgagttggcgttgctcaagttgacgaacagttcgagctaataaactaggatcgagcatcagactggcagccaagtccttttgagtttgggccgggtgatcgtaaacaaccagtaataagtcactttcggtcgcccgaatgttcagcgcctgtagttgggtgttgatgctgtttttggattcgcggtaaatacccgcaatatatttagttagactaaaatactcgatagtcagcactcctttttttataaatagtggacaagtccattatttataaaaaaaacgaccttgtcaagtcagtcgtttaatgggtcacagttgtaagtcatagttaatagtggatatggacggccctgatcatcagttggttggcgattagtgacttggaaaccacggtgttcataaaattgacgcgcccgtgggttttgttcattcactgtaagcgttgtggcaccataatcctgaatactagtttgcagtaaggcggttccaataccagcgccactagcggctggggcgataaaaagcatggctactagtgaaccatcaataccgatgaaaccagttggggtattttgatcatccactgcaacgagcagttgtggaacggttcgtaatgctgtggggacttcgtgctcaatggttgtgatttcagcgggcgttagaaagtggtgactggcgtcgacggactgtcgccagagttgagttaattggctaatcaattgcggtgttcgctcggcaggcgggaaagacttaattaacaatggtcgacctccttattttcgttgtgattgattaagtttaacataagagccggtgtcagtgccaaaactaatttaacggttggaatgacctttgaatgtattgaacttttgatggactaatcattttccaactggagaatggcggattaaagacatacatacgtaggcgagtaacaactaaacgaagtgaaatcacagttaatcagcgaccaccctcagttaggaatggcagatcaatcgacattgtattggctggctcgtatactagcgaaaagtggattggatgtgttggaatgaaatttgtaatttttggcggtgaattactggtgttagctgcctggctcatttatggtcgaacactgccattgagtttgcgtatcattggtgttattggaatcgttatcgtttcgcaattggcacattgggtattgaaagcacggtaactagcgttattaattgtgattcaaatgagcttttgatgtaaatccagaagctcactttttgtctgggttattttctaaagaattatgctaacttatcaatactgttgaaataatgacatttgtcacctgatcattatgacaaacgcgactactcgacccgattacgctggcgtacactatagtcattaaaggaggcggggataatgacaccgttgattgaagcaactaaggtcgcatttagttatggtcaacagtcagttttgactgatattaatatgacgatcatgccgggcgagattgttggcttgattggtgaaaatggggccggcaaaacgacgttgttaaatttgttattaggaatcaaacgagttcagcagggccatctcaaggtgttcgggcaagcggccggtagcctggcggcgcgattaaagattgggtcaatgatgcagggtgatatggcaattcaaggcgtgacggtgcgtgatatgttaaggctagctgcggctcaacgtctgcctgaatttgattggcaagcattattagccaccttgaaactacaagacatagcccagcaacgcttgacggcgttatctggaggacagttacgacgagtcacctttgctttggcactggtaggtgatcccgatttgttatttttagacgagccgaccgttggcatggataccaatgcgcaacagacattttggcaacagattaggcgcttgaaggccgctggtaaaaccattatcattaccagtcattacctaccggagattgaagccatcgctgatcgaattatgttgctgaaggacgggcgctttgtctttcaaggctcgtttgccgtgttgcaaaaacaatatcaacaagtggagattcgttgccaaacgagactgccagcggatcggtttacaaatttaacggcagtaactgcggttactaagcaaggcgacgaactacgcatgagtagtgaagacggtgacgctacgctgcaagcgatgatgcccataatcagtgagttgcatcaagtctcaattagtcgtgaatcattgacggatatttttgttcatctgacgaagggagtctcagcatgaaaattttaatggctcaactgagatttgatgcacggcgtttgattattcgaaacgcagcgtttcagttttttgccttggtgatgccagcagctttttacttgttatttacaaaagtaatggttaccggtggcacaacggctcaaatcgcactttttaatcggtcttatatgggcagtatgatcgtttatagtgggacgatcagtacgctgttcagtattgcccagattctaatgcatgatcgggaacggggactattacggtggctacggttaacgccacacggggtagtaccgtactatcgttcgattggcatgatgagtttgggaatgaatgcgttaacggtcgttattttaggcgcgattgcggtcgttgtgaaccacgttgatttaaccgtggttcaatggctagggatacttggaattgctctgattggtcaattaccgacattgcttatgggcgttggactctcatttttgaatcgtgccgaaacgttgagtgtcgctagtaatttaattacctttccaatggccattattagtggtctatggtggcccattagcctattaccaagctggctacaggtgattggtaaacgactgccaacatattatgtgaacgatttgttggtcaactggggcacccatggtacactaaaattaatcgatttgcttggtatcgggctgtgggtgtgcggcctattagtgattgttagttgggtgattcagcggggacttaaacgggggaatggcgttgttgacgcatcataaaaataaattgaagacgattgaatggacgagctacgtgtggctcgcctatttgccgtatacaattgcggcttacatacccgttaaatcttggcatgattggctttggctattgcttgttggtggttttcttgtgttgtacatcttggttgtcgagaagccacattggcgtgcagtgacgatgccagcggagttagttgtgacgggactgtttgcggtatttgcggctaacaattttatgatcatctttcccggctggcaagtgagctttttacttggtcgtcgtcctaaacgagaattttatggttttgctttagggtattatgcctttttaattggtggctgtatacgagactatttacaatatcctggtgtgtttgggtggcataatggtgacgtgatgggcttagtttttccattgttatcacccatactcgcgtataccttttcgtggtcagttgaacgacagcgccaactcaaccaaactaaccgccgattaaaaacaattgtggaacgtaacgagcgtgaacgaatcgcgcgtgacttgcacgatacccttggacaaagcttttcaatgattacactcaaaacggaattagctaaaaaattactcgtcaaagcaccggagaaagtggcaccagaattggacgaaatcgaacaaaccagtcgccaaaatttacagttagttcgcgaaatcgtcaataatttgcatgaacaatcgctcacagaagtcctattggcccaaactcgtaatctagcagtggttggtgtctggacgacgaccactggtgagacacaggcaaccaagtggccgacaacggtccaaagttgttttgcggcggtgttagttgaagccatgaccaatgtgatgcgccacgcacacgcgcacgaggtgcggattgattttgtcgagacggcaaaaatttatcagattaagctgaaagatgacggtaaaggtggaaccttgattcgtcagggcgccaacgggattgccgggatgcgaacccgcttgcaagctaaacagggcacctttgccatcacgagtagtcggcgcggcacccagttgatcttaactttaccaaaggagtagtgagtcagcatgataactttatacttagcagaagaccaaagcatgttgaattctgccttgacccaattactggaattagaagatgatctacacgtggtgggtagcgcagtagacggcataaacgcctggcaggagttgcaagaactgcaaccggatgtcgcaattctggatatcgaaatgccagggataaccggcttggatgttgctgatcgattggccagttcgcagctagccacgaaagtaattgttttgacgacttttgcgcaacgccgttattttgaacgagcagttaaagccaatgtcgcgggatatttgttaaaagatagtccgagtgatgacctaattgatgcaattcgagctgtgatgaccggccgcaccatctatgcgcccgagctagtcacgaatatgttgtcagcagacaacaatccattgaccgaacgggaactagcagttttggtcgaagctgagaaggggttgcccacgaagacgattgcggccaatttatacttgtcagcggggacgacccgtaattacttatccgccatttttagcaaattgggggttcacaatcgattagaagcgattcgtgtggcgaaagctaatcagtggttgtaaagctaggctgtttgaacgaggggccaactaggtttatttttatcaacacatatacaaataatttggtgcgcgatataattaattgaatagtggttaatgttgagcccacttactaattacgtggcaaatctggaagaatggaagatccggtaagatgaaagtaatgatcatcggtagtacccacgctggtacggcagcggcacgcgaaattttaacacgtcatccggagacggcggtgacgatttacgagcggaatgataacgtttcgtttgtttcgagtgggatttatttgtacttaacgggtgtcatccaacacctggaagacatgttttacacctcgccggctgacttgaagcagttaggcgctcaagttaagacccgccataatgttttacgaattgatacgggccataaaacggtgcaggtcgccaatatgcagactggcgaagtctttgatgatacttatgataagctgattatggcaactggttcatcagttattgtgccaccaattatgggtatcgatcatgagaaagtattactgtgcaaaaactacgagcaggcggaacaactttatcaatctctacaagccaaccaacgcgttgcaattgttggggccggatatatggggaccgagttagcggaaagctatgctagtatgaaccaacaagtcatgttatttcattcgcattcacatattttgaataattatcttggtccccaaatggcggatgctgcaactaaactcttacaacatcaccaggtcgatatccacctcaatgaacgggtgactggattcgcaagcggttcgaatgatcagttgatcgttgaaactgcgcagggtgattatgaggttgatctggccgtcgtttgcgcgggctttatgccgaatacggaattgttacgcgggcaggtcgctatggaccgccatggtgctatcttgatcaatgattatgttcaaacctctgacccggatatttatgcggctggggatgcttgcgtggtcaattataatcccacgggacagccggcgtatacaccattggcaactaacgcactgcgccaaggtgcgttggcggggatcaatgttttcggagatttacagccgtacatgggaacgcaagccacctcagccatgcaattatttgatcacacgatggccacaactgggttgacctatctagccgcgcaaagacgagaactaccagtacgacacgccgtctatcaaggcaattggcggccagcttatatgccgacgacggccaaagtcacgattgaactagtttataattatcagaatcgtcagcttctcggcgcgcaattctggagtcgtcacgacattgcccaagctgcaaacacgatctcagtaatgattcaaaatcagaatacgattgatgatttggcttacgtggatatgttctttcagccgaattttaatcaaccgtttaactatttaaatttggtggggcaactagccgtcaaacaagaatatcagcgaggcaatcaaacaccacgaattacagctcgtggtaactggtcgaatagtagtgataagcattgacctaacgtaaagcagcacaggcgcattaaatcacagacttggggtcatttcccaagtctgtttttatgccatccaaatgatgaaagcactgttcgtcatcccataattggtgaaaaagcctgatttgcgctgacaggaaccctgtataatagattccagtcaaaagtaggaatcaggacatgcaagtaaaagtgaaatggctgtcggggttgctagtggttttgctagtactggggctcagtggatgtatggcacaacaacaccgcatgaagtatgtacagtcaaatacgcctacgttatttttccacggtggcggtaataggtatcacgccgaggcacagatgggacaagcggctgaaaatgcaggggtgacaactagcgttattcgggcgatggggcttaaaaaagggcgcttcaagaattcgtagtggattcttgaagcgcccttttaaggctttaatgcgtcgtttgacagtcaatgtggcgattggtcaattggctgaggctggagccgataccgtattaagcttcagtgccgacgttgatgatgagcttaccagcactgtgactgttttcgctataccggtgggcggcttggagaccagccgtactaaacggaaagacttggtcgatgatgacttgtaagtgtccttcaacggcgagctgccccaagatggctaactcccggccgttgggttgtaaccaccagctggagacagtggggccttgggatttttgagccgctgttggttgcccatcaatcgtcacgagtcggccagttggctttaagattgccaagccctcatcaatggcgtcaatggtatcaaagacggcatcgtagtctgtaaggacatcttgaacagccgtcgtgtggtaatcaatgacgtggtcagcgccgatttgcttcaacagcgtatggtgattggcgctcgcagtagtcgcaacctcggcaccgaggtacttagcaatctggatggcatttaaaccaaccccgccagcaccggcttgaattaagactttctcgccagcttgaatctttaattggtcatgaatgacttggtaagcagttagccccactaacggcaaagcggcggcttgttcaaaagaaagactggctggttttagtgctaacttgtcttctttgactgcggcatattcagcgtaggtcccgcgccggccatccgcataaatgtctgggcgggcaaagacttcatcaccaaccttaaagttggtcacggccgcgccagcctcaacaatggtcccagcgacgtcccaaccaaggacaactggcatttgccagtcaaacatgcctttaagcaacccttgacgagctttccaatcgatggggttgatactcgttgcctgaacggcgactaagacctcgtcctgatcaatgctgggacgttcgatagtggccatctggagttcttcgggcccaccgtactgattaataatgactgctttcattttaaataattcctccctgaaactgaataacctagcttagcattttagttgtgctcaattcaattatttagttcggactagcgtgaattagatgcgcgtcgttttcagcagccatcaattgggcagtgtgttgtggtgattggtgaaagctgagtcgatagtgtcagtcagtaggtatttgttgctgcaggtctgtcgccagttgcgttaaaaaggttttggcggcttccgacaagcgttgtcccttagtccagactaggctagtgcgggcggttattcgaggtgttagtgggatgaaaattaaatcggattggttcgtattgatgatgccatcaatccccaacgcgtacccgacgcccgcagaaactagtaacgaggcattatagagtaaattataagtggcgacgatggtgaattttggcgtgctttcaccataccaatcctgaagttgattgatcgtaccgtgttgtgcagaaacaatgatcttttggccttcaagatcagctaagctaatgtaatcatggtcagctagcggcgaatgccgcggaaccagtaatccccagcgactttcgccgggtagatggataaagtttaagtcgtgtttgtcagttggttccgtgacgattccaaagtcaaagttcccggttttgaggttggttcgaatctgattcgcattactactcgtcacgttgatcctgattttcggatactgttgttgtagtttcttaatcgactgagcaatcgtcaaaaaactgcgcatctcggcactccctaattcaatcgtgccactgatttctttggctgtattaatgttggcaagcgtcttatcggctaaggcgatgatttggttcgcctgcgtggcaaagtattcgccactactcgtgagactgatatgacggccattgcgttcaaatagggtcacgcccagttcatcctctaaatcctttaattgtcgtgaaattgttggctgcgagacgtgtaagcgttcagcggcccgactgatatttaactcggcgaccactgcttgaaaataacgtagaactcgtaattccatctaaagcacttctttctattacaattaagtataattttaaataccatataagcattcgacatggttgctgtcaagctttaagatgaaacttgaggttagtgcagaatagttggttattcagagaataacgtgtcaagcatcaaggcagggcaccatttaaccgaagtgctctgaattaagcatcactattttgccagaatggaggaatgttaacgatgaacaaaagtaatcagcccgtagtgtcaaccactgtaaccacgatgcagtggtccagagcacagttagccgcttttagcacggcggatgattttcaagtctccccattttacagtgatgggcagacatacgggacaccgacctggatttggtcggtcgtggtagggcagcaactatttatccgtgcttggaacggtccgcgctcacgctggtatcgatcggccgtaacccaaagggctggccggattcatttggccgagagcaatcatctggtgaattttgtgcccatttgtgatgagcagttaaataaccagattgaccaagcttatcgacaaaaatatgccggtagtccgtatttaatgccgatgctagcaagtggaccgcggcaggcgacggtccaagtgatgccacgaatatctaagaaaggtgaatagaaatgactaaaataatgattattggtgctaatggtgggattgccaggaagctgacgcaacggttattagcagaaactgacgatgaactggtattgttcctacgtcgagcggaacgtttagcccagtatcgggagcaaccacgggtcacgctgattgatggcaacgtgcttgatacggatgaactttccacagcaatggcaccggtggacatagtctattccaatgttggtgggactgatctagcagcccagacgaagagcattttggccgcaatggtccgaactcagcggcaacgattgatcttcattagtgcactcggcgcccatcatgaggtgccaggaaaatttggcgcgtggaacgaacaagccattgccgatttcctacccggttttcgagaagcagcgaggttgcttagtgcttccgaactggtttatacggagatccgaccagcctggctaacggatgttgccgaaattgattatgaattgacgactggcgcagaaccttttaaaggaactgaggtatcacgagcaagtgttgccgatttagtctttaaattaatggcgcatcctgaaaattatcagcgtgtcagtttaggggtcgataaacctggtacggcgggtgaccggcctagttggttgtaattcctgtcatgagccttgattgaatgctaaaataggcgttaacgctcagacgacaacgccttccgatgcggggtggcgcaaattcaaatgacgaactaacagtgaatagatgattaaatagaattcagggggaagttattgaaaagaatacgcttatgggggctgatggcaggcctgctgttattattagttggttgtggtcgtgcagagacgaccggggtgactaaaccggttacgactcaggggcatcgctacattccgacactgtttttccatgggtggggcagtagttaccatgctgagacgcacatggcagatgctatcgttaaagccggcaaaacacaaactattgtacgcgcgatggttgctaaaaacgggacggtggctttgaaaggccactttagatcaggtgattatcgaccaattgttgaagtgaactttgctaataaccggtcttcagattatccaaccgtgggccgctgggcaaaaaatgtggtggtggcgctccaacgaacttatggcatcacgtcgtttaacatggttggtcattccatgggtaatatggcgattacctattatctattggcgaatgcgcaaaatgagcggttgccgcagctcaggcgacaagtcgcaattgctggacatttcaatggtattttaggcatggacgacagccctaaccagatgacgttgaatgctgcgggacgaccgaataaattgcgaccggcctaccgccagttattaggattgcggcgggtttatccacgtcagcaagtacgagtccttaatatttatggcgataagggcgatgggacgcattcggatgggtccgtcagtaacgcttcatcacgctctttacggtacttagttgcggcgcgtgagcgttcttatcgcgaggttaagattactgggaaacatgcgcaacacagccagttgcatgaaaatgcgcaggtcgaccggttactgattgattttttatggcccacacattaaagtggggcagcctgatggacaggcactggcgagttcgcatttttaaaattgacgctaaagaaactggggtagtcagctgacgtttgtcagtgattagcctagtttttaggttgctaccaacttgtaatgacggggtattcgcgcttaaatagataaagactgattactggtaacggtgttggtcgtttgctagcgcgatcagagtggctgattatagtaggctattgatagtagttgcgcgtccaatcgattgtatgactaatgagggtcgaacaaaccaggtcattatggtgaccaagcaacggattattggagtggggggtagtggcggatgtttagttatgagcagctcgaaaaatataatgaaactgatgtggaaatttacaggtacgttattaataatatggatagggtcggctacatgagcattcgtgagttagctcacgagttgcacgtgtcgacctcgacgattttgcgtttttgtcttaaaaatgggttcgaaggctatcgtgattttaaacgggcacttaaaagtgaacaacaacagttgaccacctacgagcccaagagcgacgtcagtgagctagcacacttttttgcaaaaactaattctagcgcgtatgaacgtaagttgatgccagcgctcacgtatttgcgtcgagccacgctggttatttttgtcggcattggttcctcaggaagtttggcccgctatgccgcgcgctgttttaccaacgctggtaaggttgcgtttggacttgaggatagtaattatccagtgaatacttttgagattcacgatacggtcgtttttgcgttatctgagagtggcgaaaccccagaactaattgtacttgttcagcattttcaacaacgccggtgcgcagtcttaagcattactaaccagtcccaatccacgctagcgaagctttccgattggaatttttcatatcaattggctcaccagagaattaatggtaattataatataacgacccaggtccccgtggtctatgtgattgagaccttagcgaaacgactataactaaagaaacgaatcgtgacttgaatagtaacgattcgttttttaagcttggaagtgaaaggggtgcttaatgatggatgaacgacagcggagtttgagcggtcagacctatgatgcacacgcaccagtatttttagagctaaaacggcgtacacggcaacttttaagccagtataaccagctcgcctatgaccaaaaaagtgagaaacgtacgatattgcaggctatgtttgccaagattggatcgaatgtttcggtggggagcccatttatttgtgactacgggtgtaatatttcgattggtcagaatgtttcaatcaatatgaactgtaccttgatcgactgtaatcggattaccattggtaataatgtcttgattgcctcaaatgttcaaatttatacggctacccatccggtcgaactgcatgaacgtttacgcgcggactggcagccagatagtgatcagtatttttgccagacgttagcgcggccagtcacaatcgaggatggctgttggattggcggtggcgtgattattattcccggcgtgacaattggtcggggatccgtgattggtgccggtagtgtggtcgtcaaagacattccagctaattcgttggcggtaggcaatccttgtcgtgtgattcggcagattaatcaaggtgaaccgcatgcttaagatgatcgcctttgactttgacggcacgctcgcgccgacgattccaatggtgattgacgtctttcgtcgtagcgttgcaccgtacgttgagcacgaactgaccaagcaagctatcgtccagacgtttgggctaaatgaggttgggatggtcaaagcagtggctggtcaacggtggccggtcgctttggccgccttttatcaagaatacgctcgcgcacatttacgggtgtcagcaccgtatccgggaatcgtcacacttttagaactgttgcagcagcaagggatggcgctagctctgattacgggtaaggcggctaagagttgtcaaatttccttggacgtgactggcctgacgtcctatttccccacgcggttgtatggttctgagtgtcaacctaataaagctgacaatctgcgacaattgatgcgcactaattcgttagacgccgcggaactcttgtacgtttgcgatactcgctcagattttgaagcagctgatacggccggggtgcaatgtttgacggcggcgtgggatcctaatcagccaattgttgaagccggtgatcagatcgtgtttacttcggtcgagcagttgtgggtctacttgcaacggcgacttggttgaagcagttaaataaacaggataattaataatcgtggtaacaaacaaattaaaaagagtggcgtgataagtcgcatcgttatataaggccaattaataacagggcatgactttagtgtttttaaagttacgccctgttattagtgttttttaatctattgatgggtgtattaggattatcagtatgtggtcaaagcgtaaatcagttgagacgatcgcagtcagttagaattaaatcttctaatcatagtaatttgcaaaataacctagtcgcacggcggattacgaccacagtgaaggggcaccaactggcctgcttatttgaatcgttccagtgctgtttaagcaattgcacgtgaattgtcaaacggtcacaccggtaatcagggtgaaattggttatgttgacgagcataactattatcaaattattcagcgcatgggtaaccatgtacaaattcgaattgcgcgggcgaaataacgtgacgacacgttatgactgtctaaattttaaaaactaaatctttttgcactttactaaaatcttagaaatttaaaaacaacatgtatatctaatcttaacgtgtatctttaagaggagtctggtttgcaagtttaattttgaattaaacaaagataagaaactaacttgtattgaataagtgccattttcagggattttgcggtagccaatcgtgtaatattccatttcgatattttataataaattctattaaagtatgaaatatattgtcgacagaactagtattattacgtataagttaaataatatgtggtgtttttttgttgagatttagctgcgcctgactcttttagtggatactattgaaagggtattgagaaatttctagtcaataaaaaagtaaggtattgatggagtgatatgctacattgagctaacttgggaaaatgaaacttttgtatgatttaaatggtgaaacaatcaatgaagaaatataatattcagtccataattgattggctttacagaatcagtactttaaaatggtttaattatttgcaagacgcattaatagctgcttttccaataattgttgttaatggttttcttgaaactatcttacaagccttaatgactgacaatggattttttgtcgttatctttcacttagaacactttgttgcaagtaatgctgttttgataaatcagctgactgtattagttcagctattacaagtttttgccaacacaataattgctgtccagttctcaagaaatgtgatcaaatctttagataataatatagcttgtggtgcaatggctgcattctcttttattattttgagcattaagttaggccagaaccatgaattgatttttctaattcatggtgttacttttgctttgctgacgggcctaggagttagtaaatgttttgatttttttagagtcgaagtcaataaggacgataatgattatcaaaacgctttaattgcgacattgacaaacatcaagcctattctctgtatcattttttgtgttttaattttaaaaatattaaattttgaaattgattcaaatggaataaacactcatctgcatagcataattcaaacagccctaaccgataatcactacagtttgataccagtgttactaatactttttctaagaagtattagtaaatttatggggattaatgcggattttctttttagttttagtacccgagcgcaattggtaaatttaaatcgtgctttgaaatttgcacatcctgttgctgctgttcatccaactgcttactcgacgttatattcttgttttgcccatttgggtggcgatggcatgttactcgcattgataattgtcgtgctcatcataggaaaaaatcaacatttgaaaaggttattgacttggtcgttcataccgacgttttttaacttctcagagccagtgatggttggctttccaatcatgtatatgcctatttatctaattccttttataatgagtcctttagtaacgacagtcattgcttatccgtttttaaagtacaatattgtcccagcgcctgtttatccagtgcctaatggtacgccaggtatcagcaacggttgtaaaatgttggaaaataccgattagaaaatgtcggttttccaacatttttttacggtaaaataaacgcatctcaaatttggaggaactgaaatgcgtttagatgttgagc

SEQ ID NO: 730 - DNA, 15200 bp, Unknown
  Metagenome-assembled genome
tcgccagcctggatcaagcccggttcaaccaagtcaaacagcaactgctatccacgcgctttacaccgacttaccacgtctcgggcattcataccgtggtcagtggtcaagtcaccaatcgctccaaacaaaaatggctctacgttgctattccagccgataaggggtggcgcgcaacggtcaacggcgtcaaagttactcctaaaacggtcattggcgggatgttagccctgccgattcagtccggtaagaatcagatccagctaacttaccacgtcccgggattgctgggtggactactgatctcaatcataagtggatttagcttcatcctttggcgtcaacgatatcgccaccattagaatcgtgtcaatcaaaacaatcggactgccaagctattctgctaggcagtccgattgttgttttaatggtcgcggtaactgctagaccagtcgcgttaatattggttttagatagggcacaattcttatattagtcaaaatcaattcaggtttcatccaaagaaaggccatatgttcagtaagatctaagttgactgtcggtctagtaacgaatgcctgtgcgctatacactaaacgcgtgtacacctgatttttagccttgtcaaaggtggaatcttcccaaataacgcgctcagtttgaactttcagcccagtctcttcccaacattcgcgtttggccgctacttgcggtaattcattagctaatgcacacccaccgggcagatcccaatagctggcatcaacattcggccgcccatgctcaacctgattgcgttttaaaattaaaatgtcgtgcccggcagtcactaaagtatgcgcaataatttgaaccatttgaattcacctcaccttgataagtcacccaaattaacggctattatatttcgtttaaccacaaacaaaagtcccaacactggcaacaccagttattaagactttcgattcaagttttattattcagtttctggccgtaaccgacctaacgataaaatggtcgccagcgccacacagccgacaactgctagactggcggcacccgtcgttaacgcgtgcggcttaataaactgctgttttatcacgacttgtaagtatgcgtgctgcttagccgtcacccggcctgttaacggactgtagttggccgccatcacaccataccggacgggcgtctgaccagtatttttaatcgctaatcgcaggttgcccgccgctgtcaacggataattcaaagtggtcaactcattggccgagccccgccaccgtttgacgacatgcgcccccctagtcaaggtaattgttacgcgctcatgcgtcgcaactggcttcaaccgtaaaacattactcttaccactaacggctagcggcgacgtaacagcgtgacccggtctaattttttgaaccgtggacacaacataacgcccattgccctgattgccacgtaccacatcagtaatccgcgtcgcctgactcgtctgccacaaactgaccacactgattgccgccagtacaacgaccaaccacgtcagttggcgccgtattactcgattaaggtgccacaccggcaactcacgaccacccacaatactgaggagcatcaatcccggtaatagtggcaacgcatagcgcccttctacttcccaaagtccgacatgaaaaaccgttaaaccgagaattgccagggcaacgaacgtcacggcccactcgcgccgcctcatcaaagtcacgattgcttgcaccagcatcgtcaggtagattgtttgcgtcattagaaccagccaaaattgaagctggcgttgatgattcaaataccagcggggcgcacgaatccactgggtggtcaacttaaagctatcaaaatcgccagtcgcccagaagacccgcatctttttgagtaaatgtacgagggtccccgtaacgcccatctgatgtaaccgctgctgaatcatttgctgggtctgttggcgcttggccgccacagtttgcatctgattaacgcgcgcaaaatcgtcatgtcggtactcacccgagctttgggggttcaagctcatcgcaatccagctggttgccggtaaggcggcatcagcttggcgcgtataacccgcttgctgttgggcagtccgcatcaccgcaaacatcaccccgagtgtcatcactaaactgacgagccagcctaacatttgccgaccactgaattgtcgttgccaccacaagatgatccccatcaatacgagagtgagccagagcacaattagattagtcttcatcaccacgcccacggccaccaataacccatcaccaatcaaaacgccccaacgacgccagccggttaaacttagtccgagtgtgagcaaggccaagctgtctggaactagtggcaaaacgagggcgtccgtatatgcaaatagtccaaatgcggccacgggaacactgacgagccacaacaaactaaatgagaccgcccccggttgccagtaacgccaacggtttagtaaatataacccactgattagtccggtatcgatccagataaatcggatgacatttaataatacccagggcgtctgcgtcagtttcaataatggcttgagcagattcgcaactaataacgtaaaattcacattattgggataaatcataaaataatgttgccaatgatggctgccccgcgctaataacagtgcctgctgccgaacgaaaaacgggtcggcccgcgccacgtcaacaaaactagtggcaatcaacatttgcacgatggcgattaagccgaccagcccaatcaacagccaacgatactgacgagatgataactgtttgagcacctgccggccagccatcgtcatgaccaataatcccagaaccatggctaattgaacgatcggtgacgcccagtccgggttgccgaagaagtgaatcggttgcaaccacgccatgccgactgcgacgaccaataccgcggccgccagccaattgacgctcttaaccacggccttcatccgtgcacccgttgcgaattcacaatagctggctgttgagttgccgtataatcatccgtttcaataatatagcggggccggtgcttgacttccgcaaaaatttttcctacatactcgccaacaatactaatacctatcaattgcatcccacctaaaaaccatagacttgtcatgagtgaggaccagccactcgttgcggtccctagtaatccttgtattaacgcatatagcatcatcatcaaactaccgccactaatcaccatgccaaacaataaaattactttaatcggtgcgattgaaaatgacgtgatcccatcaaaagcaaaagccaccatcttacgtaatggatactttgaaacactcgcaaaacgtggttggcgatgataataaagtttagttgttggaaaacctagtcgtggtacgattccacgcaagaataaattggtttcctcataggttaacagtgcctgaactgcccgttgacttagcaatcggaaatcggcgtgattaggtactaattgcacaccaatacgctccattagccgataaaaaccgtccgcggtccatcgtttgaaaagtgaatcactacttcgatcattgcggacacctaatacgatatcgctaccagcacgatagcgcgccaccatttctgggattacctgtggatcatcttgcaaatcagcatcaatcgtaatgactatctcagcagtcggactggcgacctgcatcccagccatcaacgcgttttgatgaccaaaattacgactaaacttaagacccgtcacggttgagtactgtttttccaacgacttaatcagtttccaagtcttatcttgactaccatcgtcaacaaataataacttacttgccgcattgacctgtttgtgttggatcagatccgtcaagataccatccaagatgtgtgcagacttaggtaacaccgcttcttcattgtagcaaggcacaataatggttaaccgtggattttgcatgctaattcccccaatatgactcaaatagttttacgaaataacaattataattggtacctttcagtaacaacaagacttcttgtgctactagtagtctgaatgcgccatccactgaaaaaagctcggctaacatctcaaatcatcaataacgtgtccatatgcccccacagatagacacacacgacaattgtttttctcaccatcacgaccctcgaaaagagtggcttacaaccataataattggcaatatcaatataattattttgggccaaggaatgcggccattgacataaataattgtcagtaatcgcgccacttaccgggtcaaattgatagtaccaatatcttacgcacaattcaaacaaagcaacagtttcaacgctgatcattaacaaattagccgaacttagccgaccgctagcatctcacgattatgctcaataactacaaaacctgacgcaccaacttcacggcgctttcgtccccagtactgtccagaactgccatttctaatttaatgttcaattttttaccactttcattacgattaaaatccagtaattattttataagccgttatcatcgaatcagccgatgataaatatcaaggccataactagtggccttaggcgcagcaggcaacatatgatagctacgattgccattcgcttgccgttgcgccactagaaagtatggccggcaatgatagcgttgaacaagttgtgtatattcaaattgatgggacaccgcaatgacagtcactccggcttccagtaagccgtgggtaatttgaaaattgatttgcgaccccgcatgctcattagttgatgcaaacgactcgttcattaataccaagctagacgtactcataacgtggataagttgatccattcgctgtaattcgtcatccagcttaccgtgccgttcaccttggtcttcctcacgtttaaaatgtgtcaacaccatctcaaagggcggtgtctggtaacaagttgccatgacaaacatccccgcctgagccattaattcccccagccccacggcgcgtaaaaaagtggttttaccaccttgatttgctcccgtgataacggtcaatgccgtttgaactggcaagaagtcgtttgcaactgctggttggttgagcaataaagaaatcaagggattaatcaactgttgtgcttccattgatgacgccaacgtcgcatagcaccgtggtgccgctggtagtcgtcggcttaattgaattacacccactaaccaacctgtttccaatcgcaactcttggaaccaattgacgacttcctgataaacattcactaaaatggtggctaatttcatcactgcttgattcttgtagtgttcaagtgctttagcactatgatcatcccgttctgcaatttcaaatccctgcgcatgtatctttaacttagtaaacaccttttgaaaccgatgtggtggtacgacatcaatcacctcatcaactgttgtatccagattggtggccaagtgcgctggtaaaacataaccatgatcaaataatacctgtcgcaaaaatgttttcatcggctctagttgaccgttgaacagtgtatctagcgattgataccactgttgaagtgctggcgccggatggtcaggtaatggtttgtccaatatcgtgccaattgcctgcaaatattgcgttaatagacgacttttgttgtatagatgataactagccgactcgtgaccaagctcccaaaaattttgccggaccgtttcaatggttgtcgttgtaaactgatacaaccattcgtaatagtccgggtgcatcagggcatgtttaaccgttgcttgacgccaagtcaacgcccggctagttgttaatggtgtaaaaaataatctggtcgcaatttttgcgataacgtgatcatccgctgccataatatcaacaattggttgtaattctaaatcagccatcacggctttttgactagttgttaacgaccattcgtcaagatactgctgtttttcaagcgtgattagattgacttgcatgctttaaccgcctttcaattgccttagttgtcagttgatacttgtttaataaactagtcgcatatgtcccaaccgtctccgaacaacgatatattttataagctcggatcgtcgtaccagcaataatttgagcctgcatcggtaccatatgtggaagcttagcaagactttctaaaaatgtgacgtagacaccatgggcctgctttgctgtcaaatgtgttaacactaattgacccaacttttcggcatcaaccgttgttgttgaagagaatagctcattcatcaaaacaatactatgctcatcgaccgtttgatagagcgcggccaatcgttcaatatcgtgctggagcagtcccgtcaactgggttgccttttcttgacgctcgaaatgtgtcagaacatgacttgctaggtgtaatgttgcccgtgagccagggatgggcattccgagggctgctaaataataggcctgaccaatcattcgaatatacgttgtcttaccaccttgattgggtccggccacaattagaaactgctcatttggattcaagacatagtcattgggcacgactgctgtttgtttgccagcctgaacataagccaactccagatcaaatcctgcttcaatccgctctggtgctcctaattcaacaagggtcggaagcacaaagttaagctggttcatccgggcaaggcgctgcgtataacgttgcaccgctaaataccaattcaactcagtcacgacttgttcataacctggaacggtatactgctgatattgttggtaaaatgtcgttaattgtgtaaatactgctggatacaacttatggagttgaacaacaatatttgcttgcagactagtatccccattaactgcttcggcagtcttaatactggcattgggacggtataactcgcttagatctgtcatgatgggtccaaacaacttcgtggcaacctcagcactatttgacgcagccaactgattagtcgtcacacggacataccgcccattgattgttaaataaaactgaacttgtactaatgcgctcgttaatgtgcgcatcattgtcagcaactgctgtgtcgcaggcgcctgcaaataagtatcgaggtcagcctgtaacttttgtagtcctaaactttggggctgaaaatgtgctaacgcctctgtaagcttttcaagttgctcatgttgctcatataatgccgttaacagatcggcggcctgttgatcagccgtccaatcatggtgagcctgcttgattttggcggccgtttctgcggcagccgtcacaaaatgtgccattaattgataccccgctggtcgcaacaaatctctaaaaatagcctgacgacgctgcaccgcttcaattgtcgttaatggttgataaaaaatgtctttgattggtaccggacagtcctgctgaatttgttcgaaaatcaaattcaaatttagatcttggaaacaacttgcagtagcgggacgagcgactggtggttgccctaaaaataacagactcatctgcattatgactcaactcttttcactaattctaatcaataaaaaatggcgacacctacttagacttaaatccaagtaggtgtcgtcattagcattactgcttgttcggtgaacaccatcaccgctagaatgatttcagtatagcacgcgcactgaccttcgttaaccactttgcttttattaaaaatttaattaactaaacatcacgcaaattgttttcaaccaggcccattaccagcagatactatgagccagtccaagcactggcatgacgaggtttccgagattggatgttggttgtagaaaaaatcggttatacgttgaatttctttcctagtcaaccgtgacgcttcaaagacgagaccagctatattgtctaacaaacagcggtattacaatcatcattattatttgaacaggtagtttttaatttagatgattatattgcaagcaaaggcaccgctgctcgccatttttatacaactagtgccgttgcttaacttgattaacatttcgcatctgcgaattatcaagggttttaaacttatggttgaaaaacgcttgtgtttatttttcaagcgcggtatgctgtaaccgttaaaaataaatggtgatgacgttcgccgtaactaattgactatcaatttgatgacgtctactttcaatcggaccttagcggggcctttgaaagtagacgtctttttttatcaacttggtcgtaaaatttgaaaggggttttcaaaatgtcagttgtaattgatgttgttaaagcacgcgaggtttttgattcacgaggtaatccaacggttgaagccgacgttattttatccgatggaacgttaggacgtgctgaagtaccttctggtgcctcaactggtactaacgaagcggttgaattacgcgatggtggtcaacggctgcaaggcaaaggaacttccaaggctgtcaataatgtcaacacagaaattaatggcgcgttacatggcgtcagtccgttcaatcaagctaaagttgatcaaatcatgattgatttagacgggactcctaacaaaggccgtttaggggccaacgcaattcttggggtttccatggcaacttgccgagcagcggctgctgagacacatcaaccgttgtaccgctacctcggtggcactgacttagaattaccacaaacattccataatgtcatcaacggaggtgaacatgccgataacggcatcgacattcaagagttcatgattactgccgtagatcgcaccagttttcgggacggatttgagaagatcgtgaatacttatcatacgttaaaaaaggtcattgaaaaagcaggctatacaactggcttaggcgacgaaggtgggttcgcacccgacttagataactccgaggccgcactacagatgttgcataacgcaattgtacaggccggctacgttcccggcaaggaaattgcgattgcttttgacgccgctgcttcttacttctacaatacccaaactaagcaatacgattttgaaggtcggcacctctcaccagaagcattaagtgattattatgccaccttattgagccaatttcccgagattatttctatcgaagatccttacagtgaagatgactgggaaaactttgttaagttcacccaaaaatatggtgatcgggttcaaatcgtgacagacgataacgtctgcaccaaccctacactcttcgccaaagctatcaagatggggatggccaacacatttctgattaaattaaatcaaattggaacggtcactgaaaccctgacagcaattcgcttagcacgcaaaaatggctacgcaacaatgatgtcccatcgttctggagagactggtgataccttcctcgctgattttactgttgcaacccgcaccgcacaactcaaatctggggcccctgctcgttcagaacgtgttgaaaagtacaatcaactgttacgaatcgaagaagcacttggtacagaaggcacccggttagcgcattttccagatgacgtcgatcacgacctctaaaatcgcaattgacggagcaaccaaacagaggtgattatcatgcaagcacccacaaacatactaatggggctcacaacaactgaagtacaagaacgtttgcagaaatacgggcccaacgtggttcctcaacgccagtttagctttcgtcacgccgttattactcggctatgggaaccatccgcgtagattcttgaagctgccctactcgttgaaatcctgttgggtaaaacgattcaagctggttttattgttttgatgctcctatttgctgctgtcacgggcgctattcaagcatggcgctctgacaaagttcttaaaacattaacgaatcaattgaccttaacggttgctgtcaaacgaaataatcactggcaacacgtttcagcaacccaaatcgtccctaacgatgttattagtttgaacaatggcgatctactacccgcggatgttcaattgttagatggcacactagaagtcgatgaaagtagtatcagtggtgaatcacgtgcaattcgtcatcaagctggggaactagtatatgctggcactgaaatcaagagtgggcacggattagcagtcgtcgttagtacgggaaagcatagtcggtctggcaaaacaattagtttgatcaaccagtcatccgcacccggtcagcttcaaaagctactcagcaaaattattggttatctggccattttggacaccgtgctggcgattgtcttggttctcaccgcaataatacgtggtgctaacttgattacaatgttgccatttctggcgatgctgtttatcgcgacaattccgatcgcaatgccttccagctttgcagtggccaactcagtggaggccaaacagttaggtcaaacacacatcttagtcagtgatttatctggtatccaagctgcggccaatctgaatttgctactgatcgacaaaaccggaacgattactgccaatcagccaacggtcgtcgcaatgcataacttttcccaatattctgaccgcgaactaatctgctgggctactagtgctactaatcaacaaaatgcaagtgtcattgacgctgccattctcaactatgcccgtcagcaagctgtgaatgtacaagtgcccgcacacttcgagccttttaattcacagcgtggttattctgaaggaacggtgctggccgatcagcccattaatatcaagctaggcgcttaccaacgcctgtatcagcttgatcaagatgcttcaaaattgacgaaccaaattgactttagccgcggtcgtaccgttgcattactagtcaacgataagttagtcgctttattcatcgttgaagaccagccacggccagacagtctgcaagcaatcaaaaagattactgatcgcggtgtcaaagtcattatgttgactggggataaccagaagacagcggcaacggtcgcacagcaagtgggcctaaccggtaatgtcatgccattcaacacattgacggccgatacggacccccaacaattggctggaattacagaagttattccagaacataaattagcgattgttcagcgttttcaaaagttaggttacgtcgtgggcatgaccggcgatggtgtcaacgatgccccagctttaaaacaggctgacgtgggcatcgccgttcaaaatgccgtagatctcgccaagcgttctgccaaactcgtcttgctgaaacccggattgacaccaatcattcagattcttgatagcggtcatcgtgtttaccaacgcatgatgacttggacaattaccaagttgtcacgaacagccgaattaaccatgctactcacattgggcttcttgatttggcaactgattccgttaagtctgaatgccatgattctggtagctatcttaaacgactgtgtcaccctcgtcttagggaccgaccgcactcacattacgtaccatcctgagcgctgggacctacgccgtttgagtaaaattgctggtgttttagcgattggatggacgacccttggaatgggtgttttatacgaagcacttcatcgaggattgacgccaggtcaaattagcaccgtactatattgttatctaatctttagtgcgatgctcacgattctaatgacacgcactaccaaaccattttggcaacaacgccccagcaattccgtaatcattgccatcacgatcaactgcctgattacggctggtctggctctgaccggcctaggcattgccaaaatcagtttatcgtacctattagtcacgttggcaattgttctagtcatgggggggttactcacaattattcaaccacgtcaagattaactcgacagaacgctataaacgctggaacttctttgaataccagccaattaaaaagtgtgccggggcaaggttgggttatgtctatcgcactattgctcagtgacactagtgttgggaggattttgttcatgtcgttgaactagtcacattgaactagtttggtcgttacaattaaattcaagaatcgagtaggaggtaattgattatttcaattaccgacctctcacaccaccgtacgtacggttccgtatacggcggttcaataatttaagcactctgtgtatttgctggagtgtcttggacaggtttattagtccaagacgctccagcttttgatttgtatacgtataggttagtgttttactatgggcagttttccaatattccttgcgggtattggcattagtcttggcctgttccggtgtcattcctagcttaattagctcacgatatcgggttttgattttcttccaccgtttccatatcaactgtctaatcctacttcgcaaccattggtccagttgttgaataaacgtcttcatcttgccaatcccatagtactgtagccatcctcgcattttctgtttaatttccttcatcaacattaaccaactaattccgctacttcgcccagtcattatcttaagggcttgtttgattcgctgtttcacgaccttgtgcggtcgtgcatatgccccattacggtctacaccgagcgtaaatcctagaaactttagtcggagtggtgggccaaccgtcgttttatgacggttaattgttagttacaacttaatttcaagaaagattgtgacattgtgtaagactcgttctcccgctcgcttacttctgacataaatattacagtcatcggcatagcgcacaaattggtggccccgctgggtcaatagcttgtccaactcgttgagataaatattggccagtagcggcgacaggttcccaccttgtggtattcccttcgtcgtctttcgaaaaagctcgccattcatgaccccgcttgttaggaagcgccgaattaggtggagtagccatggatcagttactcgttgtttgatgaagttcattagtaagtcgtggttaaccgtatcaaagtatgccttgattgcagagttcggtgacactttgaatcgcgtcatgcgcactccgacctggtcggaatccatagctattgtcggaaaatacttgttcgtatatcggcgaaagcacctgtaccacagcttgttggatcatacgatcaacaactgtaggcactcccagttttctggttgagccatcgggttttggtatctctacccgtctgactggttgcggccgatatgttccattacgtaaactctctaggagttcttcccggttcttgtaaatatattcggccagttggtcaacggtcatgccgtcaattccagctgcacccttattcctccgaacacgcttaaacgctaggttcagattactacttgcaaggaaggacccggtctacaaattgaatgccatcctgcgccgtactttcaccgttagtagtactatgcgccccaagatactctttgtcttccagactattcatcccttggcggtcagcttattctgttttctgtaatcttcgcactaccaacacctccagtatcggtgagaattattattgttcagtccttcatctgccatacggcagattactatgacctcggctgactagtttactcctgtaaacccatattggcgtccttgttgggagcttatccgacaggcctccccgggtaagaatgatagctttcataccatgcaaccgttggctttactaacttcgacttcgagtagtgtaggacttcagtttgtgaagcaacttcatccagtctaatcagccttgtagccactccttgtacatcggttcggtattttgtcttaggcttccttcagactccgtctcacggcggacgcccttgccctcaactcgtggttccgactactacggcccacagcggacttacaccgcctagttatcacccatgccgggcgcacttcaaagatggatttccagaatttctggaagcctattttgatgctaatctcaatcttagtcagtacttatttcaaatagccaattaacgaaacggcacccacacaacggctaaaaataaaatgagccctaacacgatcatcattaagtgctgctggccttcattcgtttgcggtaacgttgccgccttcgaagtttgggcattcggcgctgtggattcgcctaacgcataccttgccgtggtaccggtttgtgtgcctggagccatgatttcatgaatagcccaagccatcatttgcgtgatctgagtcgtatttgctgacggtgtaccagggactggcatcccccgctgtttcggttcagttgttcccggctgctccggttcggtcggctgcgcctatcgatcagtcgccgttactgtcactaccgccgtctgaccattcacaattgtgaagtctagcggcgtttgatttaagtcataactcgctggagccttagtttcaacaaattgatatcggccagggattagcttatccacacggatttgacccagagcattggtgaccagcccctgctgaatcgtcagcccggtagcgtcaatcagccgataagttgcccccagccagcgctcggccattgctagcatcggttttagtcagcacaactgccccagtgaccgccaccttttcatcaaattgggcaacttcaactggtgtcgcaattgtatcgacatcaactgtgaagttgattggtgttgggttcaaagcgtagcccaatggtgctttggtttcgacaaaccgataatgtcccggaactaagccagccacattaatggcaccctcttcattagtcgtcaatccagattgaatcacttcaccatgctgatcctgtaactgatattcagcctcactcaactcacacttaatcgtagcatcgcgtttgaccaaggttacgctgccaagttgattatcaccgttaccagtcccattaccaccataactaacattgccactaacggtcgtgccattcatagatgcgaaattattccagttattactacttcccgaaaccttcgtcaacttgctgttataaactatgttaacggcagtcgtaacattgctaaaagtgaagaggctgtgacataagtctctagaaacaaagcaggtctggaaaaatcttcggatttttccagacctgcttttgatataatagaaaataaaaaaagagcatcggtcgcacccgatactctacgaaa

SEQ ID NO: 731 - DNA, 78883 bp, Unknown
  Metagenome-assembled genome
cacctgttcccatgtcgaacacagaagttaagcttcttagcgccgagagtagttgggggatcgctccctgcgagggtaggacgttgccatgcaacctaaggaatcgttaattcgattccttttttgttgccaaaaattagtctactgggcgaactaagactaaattttgaaattcaaacggcgggtcggattattaggaatcccggtactcatcagcgcattgggaattcaacctatactattaatcaccggcacgatctacttattggttgcaatcacgctcattgtactgaataagtttccgttgagttgaatcgttagcgattgcgctcaatgctcatattgggggtagctggcagtgatgggggagctgtcaaaacgagagacagtagcgttcggattttgagagtcaggcgtaaatggcgtacgtttggttggttagaaaaatcgatgctagtttcaagcgataaagtgattcagctcagtctaaggtactaggtattggtttacgaacttggccattactaaccgctaatacgggctcgtgggcctaatgtcatttaatttggacagtatccgtcataaccatgtaaaaatcatgtaaattcgggagcaataattgttattctagcagttacgtgctatgttattatcatattttatgaagtggagtgatagttatggctcagatttctgtgggggatcgggttaaatgtcaaaagaacggcaataccgattatgatttttatgctaaagttgaaaaaatttacgagaactccgccttcgtcacaattactcattatgatttgcgggatgatattaatgtggcagaacttcaatatcgggcagtgatcgccttaaagaagatgaaacccgctaaaccgactgctggtgaagcgaagcagctacaggcagttagtgcggccatgttagctgaataaattaagaatatcgatgcaacatgtaggtaatgggttgttcaagaatttgattcttgaacaacccatttttagtttggctgcaaagcttttcggtgtgatggagtgccctggttgggactgattttatgatgattagaggccaactgacttaatgaatctgtccgttagagctttaacagattggatatttaacaatcattcacgcgggtgttgttacaagctaattgtgcacgtctctttattcggtgtagcaaacttttttgttggcaatctgacttttagcctgtacatcattggtttcaatggtacaatggatattagtagttgataactgttctaaagtaaggaggagttttgaatgcagacagctaatcaaaatgtaacgttgacggggcgtcgacgcttctggttcatttttacgctgttgcttgggacttggaccatgtcgatcagtcagtcttccttgtcgacggtctacccaacatttatgcgcgactttggcatctcggcctcaaccgtgcaatggttaacgaccggctttatgttgacaatggtcgtcatgatgccaatcagtccgtggttgttgaataatattgggtttaagaaattattcttagccgttttggtgcttttcgatattggttcaatcattatttatttcgcacccagttttggtgtgatgatggtcggtcgcctaattaaagcggcggcagttggcgtgctgtttccctcgtatcaatccattttactgacgattacgcccgaggaaaaacggggtagtacgatgggtgtcgccgggttggtcatgggatcagcattagcatctggcccgattatttccggtgtggttttgaagtttaccgattggcacggattgtttgccgtcttcatcacggtggcaactttgttgatcctaattagtttcacaacgatcaaggacgtgatggtcaataagccttcaaagctagatttgctctcaatcgtgacgttactgggctttgctgggattttatacgtcgtgaatgagattggtaaacccaatgtgaactggacgttcggttggctgttattagcggtttcagtactagcggtggcttactttacttatcgccaatttcacttggagacgccgttattggaactacgggtcttaaaaacatttaattatgacttagccattttcctaacagcaatctcgtacgtggcgctgattgtcgtaacaatcatcttcccactctattaccagggtgtcttgaaggtgtcgccattcgtttcaggcatgtcactggtgcctggtgcggtgcttctaagtattttgaacccacttactgggaaactagcagagaagattggatacaaacaaatcatgttacttggtatgagtatgatcgttgttggttggctgatcttagcactgatcaattcagagttgaacctgctcaccatgattttgctggctgccttaattgaaggcgggaatgcctttgtcatgatgcccgccgtcacattgggggctaattcattacccgatgaactgatttcacacggtaccgctgtgattacgacggttcgtcaaattctcggttcagctggtgtggccgtggcgaccttggtcttatccaacgtgacgtttgctcagaaacaagcgggagtctcaacgttgcgtgcgaacttgcaagggtaccatacggtcttctggatgatgctcggcattgaattggttggcctcgtgcttgcgttacttttgcgtgatgggcgcaagcagtcgcattaataatcacggtgactgactaccaggcgagaatgactgaagttaagtgggatatgctttgaacgccactaattagacattagtgcctgcacaatcggtcggttagtcgtaattaggccaaaagggccgccattcttgattacaagaatggcggcccttttttcgtggcacgactgtgatcgtactgaatcacaggacttggcccaactaaccggggcgcttctacttggctgttgctttttgaatctttgccaattgacgatattgactgagcatccagctttgatacgtctggttggccggtaacgtttcggtgaccttcagtaccggcacatcgtatttcctggcgagtttgaccatgttcgtgaccaagttactatcggtctgagtgttttcaacgaaaaaggcaatccggtggtgcttgatgtcttgttgcatttgctggatatccttaggtgatgggtcggaaccctcttcaattgcatgtgcgaaatgcgtattgctgattcggtagccgattgccttcaatgagtagtcaaagaccggctcactgacagcgacacgctgattatttgcatgctgtttcaattgtttgatcatagtggttatggtcttagcgttggtctgatacttttgggcctgctgttcaaaataatgcttgtgctgcggctgaattttgctgagttctgttgcgattttagttgctaatttgggcatcgttgtgggatcgtaccagacgtgttcgttggccccgtcagttttatgagccacgtcggttcccactgtgattacccgggcgcccttggctttgttgacagtaagcttttccatccagtcatcgtagccgaggccgttgtaaatgattaattgggcgctactagcctgcttagccgtgttgacggtcggctcgtagtcgtgggggtcaacgctcggtcgatcaataatcgaggtcacttgaccatactttcctgccaccgccttagccgtttgaccataaaagtcgagactagccatgatattaattttgtcgttagtcgttttactgggggtgctcgaactttgacagcctgctaataggccgctgagtcccagtattattgccaaataaagccatatccgtcggttgaccatgtattgtaaccccattctctttaaatcgtaaccattactgttaactttaccgaaagaaacggtcgtcgtcaagtctttaagataaggtttagactaggtgaaaacactgcactgactgacgaaagctggtaaaataggcgtacctgaaaagaggaaggcggggcacgcagatgatatttacgattgtgattttaattttactagcaagcgcaatttttcgcgggtttcaccgcggatttgtgattgaaatgttgcatctgattgggacggtcgtcgtcctattgtttgcacgactactctatcagccgttagggacaatgattagtaatctattgacgaatttacatttaattgaagcttcagtggcggcaacgttgatcattaacctggtcgctttcttcgtgttaatttcgttagggtggtcagtgattcggttgttaggccgtgtttcacgtagcattacgtggctaccagttattaagcaagtgaacagtgttgcgggtggaatcgtgtcatttgtcgtgacgtatctggttatttttgtcgcgttgtcgttggcgaacatcgtcaatacgagctttattcagacgcaaatgacgcagtcaccgctcgccacctatattgtgaagcagacacctggtctaactagccattacctcagtaatttgattaattttaatgatgggacgactacggattcctagagttcatggtgggggtacgactgctttaaactaagacaaaggcgttactggttttttgaccagcaacgtcttttttgatgaaccggtttgttagcaacgcacttttttcggttcccgaacgattgctagtttttatggggttatttggctgattactatcatattgagcgtccttcatgctatgattataagtaaaaatgagcaagaaagaggctgggatacttatgggcatgattcgaattaataatttacgctttcacacgtttaacggggtacttccggaagaacggcgtaatggtcaacaactagggctagatattgccattaaatatcctatcgaaaccaaggttcaacacgatgacgttcacgagaccatcaattacgcggcggtccgtaacgtggtcgatgaatttgtaacgacccattcatacaagttgattgaatcgctagctaaccacttattgcagacgttattgacaagttttcccgcggcggatgcaatcaatattaaaattcgtaaatatagcgtaccaatgcctggaatctttgatgatgtggaaattgaggtggaggggacgccgaatggcaagtagggaagaacgggtttatttgagtgttggttccaatattcatccgcgcgtccaaaatattcagcaagcccttagccgattacgagccgtcaatggggtaaacgtgattgacgaatctcattggtatgagactcaaccgtggggaaagcgtgatcaggccaatttttacaatgtttcggtatccttaacgactaatttgacaccagaagaactattggatgaattacatacaattgagcaggcgggccaccgccaacgcttggttcactggggaccacgtacgattgatttggatattattttttggggcgaccggcaaatcaacacagcgacgctgacgattccgcatgcgcaggcagctaagcgcaactttgtgctactgccaactgctgaaatcgccaaaactgatgtgttagttggaccacaagtggcccaattgattgcggctaatcaggatcagagttggattaaaaaagtaagaaatgtgagtgagttagatgattgatgagaagaaccaagcaaagattgagcatgcagtacgagaaattttaagtgcagttggtgaagatcctgaccgaccgggattagtagaaacaccagcacgggttgcacgaatgtatgcggaagttttcgctactaagactgccgcaccatttgataattataaactgttcaaggttgagcatccgactgaaatggtattacttaaggatattccattctattcgatgtgtgagcatcaccttttgccgttttttggcacggttcaagttgcttatgtgccgcagcatgaacaagtgattggcttgagtaagattcctcgcttgattgactattgcagtcaacagccgaacgttcaggagcggttgacagtttccattgcaacagaattacaacgaattcttgacccggctgggatcgcggtctcaatcacggcgcggcacatgtgcatggagatgcggggtgttagcaaaccgggtgtgcatacggaaagtagctattacagtggtcaattcaagacggatttagacttgaaacgagaattcttacagcgaatcgcaaagtaggtgattaagtggatacagggacgattgaacaacgttatcaggatttattagcccaactaaatcaagccatgttagccaataatcatcagcgtgttccgttattacggcgcatcatggcacatcttggccaccctgaccattattaccatgtgatccatatcgctgggactaatggcaaaggctctacgggagccatgttagccagtatcctgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcagaccgaagcgctcaatcaaggtgttcggctagtgaccgctaagcacgcgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcagtactacaacagcaacaagttaacttgacgaacagtgcggttcgccgaggcttgcaacaagtttccttgccaggccggttgaccgtattacaggagcaacctgtcattattgccgatggggcgcataatccggatggtatggcggcactagtggcaagtgtgaagcaattactcgctggtcgtaaattgatttggatcgtcggggtcttacaagataaggcctaccctaaaatgctggctgaactattaccggtagctgatgtcctgattacgaatacgcccgcaaatccagaacgagcgttatccgcgactaagctggccgacacggcgaacgcattattaacgcccacctttatgaccacggctgcgatgcaacgacagccagacttattgactgcaacgacgatcacggatgcgttaacgcaagctcagcagcaagcaaccagtaatagtgcgattattgtaacggggtcattttatgtcattcgtgagctccaacaggctggttggccggggttaagccaatgacgacgacttggttgattgcatccaacaacgctggtaaaagccgcgacttgatcgcgtgtttggcttactatggcttgactgctcgtcagtacttgacagtggcgccgcggctcgaatttcccgtggaaacgacgacgagctatgtcgataacgcggttgctaaagctcgttttggggcgcaacagctaggggttccggttatcgcagatgatagtggcttagagatttccgcgttaccagacttgttaggtgtgaccacggcgcgcgacttaggggttgcagtcagtggctttgattgcaatcaggaaattttaacggccctacgcgatatccctgacaacgagcggcaagcgttgatgcgtgctacgttagcggctgcctggccagatgggcggatcttggccgtacaagcttcgatcaccggctacattgcgtcctatcaatttggacgctattctgggggatttgaccgaattttctggctaccgcgctatggtcgaactttggccgaattaccagcaacgtggcgcatcccgctgacacaccggggacgggccgccttaaaattaatcacaaaactttaaaaattggaaggatcggtggagtagatgttagtacaagatatcaccagttcattagcacaagcaacggattttgcgagtcaggcgttgaatgcccaagttcaacgacaacaacaattagttttgcgttttagtgattataatcgggagcagcagctccgattaacccaactatgtcagcaattagatggggtcgtgcaggcgagtcctgaacagttgaccgtcttgctgaaccagacagctggtcgccagttaacacaccaatggtcgcgagtctttacggatcaagcaacgactcaaattcaattgactcaaattatgaaacaatatgatgttttttggcaagcgggtgagcaccggtttaatctcaccaagaagccgatgatttatggcatcatgaatattacgccggactcctttttcgacggtggccagtacaagactaaagatgacgtactgaatcacgtggatgccatgttacaagcaggagctgacgtaatcgaagttaatggtcaaacgacacggccgggcttcacggaagtcacgccgcaagttgaattagaccggacgttgccgtacattcgcgccatcaaggctcgtttcccggaagcagtcttagcggtcgatacttataagtatgatgtcatgcaagccgtcctggaagaaggtgtcagcattattaacgatgtgaacgcctttacggacgaccctcgcaagctcaaattgatggctgacagtcgcgtcggcttactgactatgcacagtagtcgtgaccaagaatataccgatctgacgagcagtatgcgtggtttctttgaacaaaatctggcagcattgacgagtcatggcatcgatattgaacgaattgctctagatcagggaatcggctattcacaagtcgcacatggggaacaggattacgtgatgatgcgtaacattgatgaatttaattatttgcgacgcccaatgatggtggccatttcacggaaaggttatttaggtctattgcttggtctgaagaaggaagaccggctaccaatgacgttggtcactgaagcagcgatgatgcttaagggtggccggatcatccgggtccacgatgtggctgaaaccaagcaattgattacgctgttaggccgaattgagaatggctattggttatcgaataatgattagtccggatgattttgacgatattacggcgaatggggttaaggactatgatgcttatttcggtactcccacgtacgatgatcacgttttatttgaattgttagtggttggaatcttacaagtgggtttaggctggcgggtcgcggctagtcagttaccagtattgcggcaacatatggcgggtctgcgggtagatgccgtagccgccctggacgaaccggattttgaacggctgatgttgactcccaaagtgatgcacaatggtcgtaagttacgtgcaatcattcaagatgcgcgtgctattcaacaattacaggccgagtatggtagctttagcaactacctgtgggcgtttgtcgatgcgacaccaatcattatgccggcgcccgatgatgaattaccgacgcgctcacccctgggcgcccgcgttgcgaaggatttacaccgacatggtttgaccttcgttggaccagtcgtcacccacatgtttttgttggcggcgggattgattaaattgaattaagtagaatgaggctggcggatgctggcctttttttatttgcttatgccggcgtatttttgtgagtatcaatgtgtgaatgtaagcaaggtgggtgctttgatccggagtggttatgggaagtgtgattattagttccaacgcaatatgaagcgcaagttcacaatgagggtaagcggcaaaaacatatttgaatggtcggtgatgctggcgtgtagaaccagtctaaccgttttctaggtaatagtgaagttagcaaaaaaacgtcgcaagagcaagttgtaatggccttgtgacgtgttttagaatgagttgattttgtatccctctgacacgactagcggttagcggtcgtcgagtctggcaacagccacatcgttaccaagccaatcagccaggccactaagaagaacgccatggcagctggtaattgatagccaagcaaccattggcataacaagataagcgtgataatgataccgataacgcgattgatgatgctcatgtaagtgcctcctaggtggttagctaagaatgaagtgaaccagattatctgaattaataaatattacttaaattatataatgaatgacgttatgtgtgctgcaatgtgcgttaatgtcttaatttaacgtacgaacgtcgaaaaatgctgaatatttgaaaaaacgataccgctgaggttgcggtatcgttgaacctgtgactggtaattagcatcgtagtgtgactaactcggatactggttagtgataactacttctagtaccataacgtttcagcaaacggtatagcgtttggcgcatagattttgaatgaataagcgttatccacaaaaatcatgctcactgcatcagactgatggttatactgtgctaaatgcccagcatgagcgggttaattgcatgtctggaaaatacagactagtttttttacttaagaaggttgtatttatctgataagacacctattataaattgcaaatataagtaagacatttaggagtgattggttatgattaattttgttttctacaaatactacagattctgggctgcaatcgttttactattgctaagcgctaacgtttatccagcaattgttaacggtaatgtcttaggtcgcgaattttggcgaaatggcacaaatctgattaatcttgtttttgtaattgttgctattggctttttaattcaagtgttgttttttaagaaaggtgagccgcgtgcgaatgaacgtgcattttgatcaggtcatggtaaaaaagcatgatttttaatcgcgttatggcaaccaaagtatgagggagtagtcgaaagtctgatatgaaattctctgaaaaactaaaagtgtgtaggaagcacgcacaattgacacaatcgcaagtggccgaacaattacatgtatcgcgcaaaacaatctcaggctgggaaaatgaccacagttttcccgatgttggcagtttagttcaattgagtgatatttatgacgttcggctagacgatttaatgcgggatgatcacttactggcttattataaggaagcagaacaacttcatcagaagagccgaaaatgggtggtcgtctcgtatcgatgcaatttcttgttactggtacttggctacattgactatttgcggccgtttggaatacgaacgtttttggtaccgtttttagtactggtgaacgccatggtattattgtcgtatttttcagattggcagcggttcaagtcaggtaaattgcgtgtcggtatcgtcatcacggtgtttattgcatttattgctgagattctgatcaatacaatagtaccgagttatctgaacgagttagcacatgccgttgatgatggccccgctgcgataattggtgaagtggccggtcgcttgctggtcacatcaatactgatattaagtttggtattagctatctttttgaagccaaaacaacgagaacggtcgtagtttaccgagctagtcaatattgatgagtttggaagtgagccgtggcgtctcaaactaacgaaaatgtgtaagacaaaaaacgaccgcatgcttaatagcatgcggtcgtttaaggcggaagagatagtttatacagaaacagattcgatttggatgctgtgtatcataacttaactcacgatgaactaaatcgaactatccgttgtttcataatccaccttgccaagttcaatctgaatcgtgatatgagttagtggaaactgggcgcttaggtccttgttcagttgttccaaaaaggcattattgtcagctaatgttgaacgacagagatggacggtcatggctgtttcagtagtactcatgccccaaatgtgtaaatcgtgaatctggttgacggtgggctggctggttaaataatcagcgattgcttggcggtcaacattgttcggtacagcttccagtgaataattcatcgcatctcgtaagagtccccaagtaccaatcaaaatcacgacggcaattagcagggaaacaacggggtctagccagaaccagcctgtcttcaagatgatgaagccagcaatgaccacgccgatggagacgccggcgtcggcggccatgtggagaaaagcgcccttaatattgagatcgtgcttttggcccttcataaagagtaatgcggtaaagccattaatgacgaccccaacagcagcaacgataatgacatcccattcggcgacgggacccggattactaaggcgctggatggcctcgactgaaatggccccgatagcgactagtaaaaagacggcgttgaagagggcggccaagattgatgagcttttgtacccatatgtgtacttatcgttggcgcttttttgtccaagccagattgccagccaggagatcagtaagcccaggacgtcgctgagattgtgtcctgcatcagcaactagggccagtgagccgctcgcaaaaccgtagccagcttccaagacaatgaaggcagtatttagggcgaccccaatcttgaaggcgctggtctgttgttgtatttgatggctgtgtgccatatgaatcacctacttcttagttgaatttatccttgttatggctataatttaaatatgaatgaacaaacatatgaatgactgttcatgtgtattgtaacacgcttacatgacaatctcaattagaaattggagtttatgatggaaaatgaaatggaccatgaaatgatcgtcaaacggttggctgaactgatgccgccgactgatgagttgagtcggatcaccgcaatctttaaggcacttggtgatccgacgcgtgcccggattatctacgcgttggccgtatctaagctgagtgtgggtgaactggcgacgggattagccctgacacagtcgaatgtgtctcatcagttaacggtcctcaaacaattaaaattagttgtgggaacgcgcaatgggcgtaacgtgcactaccagctggccgataaacatatcattagtatttttcagcaggtcgcagctcacgctgaagaagccgataattaggttgaataggtgtaaccactgatcagttatgatgagtggtaagcgctgtgggttcgtagtgggcactgatatagatatccatggcctagaggaccgcacgattagcttgaatataagattgtgcttagcatgacaccgcgaaatggttaatttcgcagtgtcattttttgaactagttatgtttttgttaattacctagttttataaactagatgtattgatatttacactatgtgatggtatgctggtgtcaataataaatatgaggtgattaacatggcacagtcggcgcgacagtatcaaataacaaatgaagtcctcaactcagtgactcatgggattgggattattttaagtatcgttgcatttgtttttttgatgctcaaggcatatgcggatggtcagcccctcgaatgggcggcgtttattatatatggttgttcgttgtttgtactatatacgtgttcgacgttatttcacggattatactttacgcgcgcccgcgaagtttttcgtatcttcgatcacagtggcgtgtacgtgctgattgctgggacatacacgccgtacagtctactggcgattaagggttggttgggctggacgatcttattaacgatttggattttagcgattgctgggattacggttaatgctgtttggcctggacgtttgaaaaaggtcgaaacggtcatttatgtgttgatggggtggatgtgcctcgccggtggtcggcagttatgggaccatttaggtgtcactggcttctggttattagttgccgggggcgttgcgtttaccttaggtgcattactatatagtttcccacggattaaatatttacacgttatttggcacctattcgtgatggtgggaaccacgttgatgtttttctcaatttatttctatatttaaggatgactgtggggaccagctgctgagttggtccttttttttttagatgcgggagatttgagtcgcggatgacgtcttaaatgctgattattgacattttattgcgaaaagtttttcaactggacggtattcgaatcgtaaccattgcgtacgctcgttaagctgaatgagttatcgccactcagctaacaataattttgaaattaaatggctagatcgctgtagcatagtctagaatacgatttatttttgtcatcaaactgtaatcagccaggcgtatcttttgattgcctttttaaataaacttccgtagaatagtaggacaacgaaatttttagtgaggtgattaagatggcatacgggttattatttggtggcattttcatggaagttttagggagctttttcttaaagcgcgcaaacggttttcggaacttaataccaacgataatggtgttggttggatattttagttcgttagtccttgtaacgcttgcaatgcaacgcctgccgttaggggtgacgtatgccatgtgggctggactgggcacgtttgcaaccgttattttagcggtcgtcgtttaccgtgaacggctcagtctctcacgtctgagtggcttaattgcaatcgtagtcggggcgattttactgaacatttaaatcaagggggaatgatgatgcgtgcatggattcaattagttattgcgattggcgttgaaattgcggggaccagcttgttgaagttatcggctggatttaagtaccccttggttggaattgtgggcatgttactatacggcctagcgatttttagtttctcacgggcattgagcaaaatcccactgagtgttggttatgcaatctgggccggagtcggcacagctgcgaccggcctgattggaatttgggcgtttggcgaaatcttgacgggattgaaaacgttgggattcatggcgattattacgggtgtgattctattgaacatgcctgctaaggcgactaaaccggctactgcgacgccgcgcttggcacggtggcggacccggtttaaccggtaactaaaaagatcgagaatctggctgatgttttaagcgattacgcttgaaatgcgccggttgattctcgatcttttttagttgttgtaattaggcttctgaccagacttccttagccgtaccaatgactaacgccaacttggcccactgttgagcctcagttaactggttaccttcttcagttgaagcaaagccacattgggtcgatagtgctagattacgcaatggcaccttagtggtcgcagcttgaactcgttctttgatcacagtggtcttttccaattctggaaacttagaggtaaccagacctaatacgatgcgtttgtggtcatcatggttccaaatctggtctaacgcttcgaagccacccgcccgttcgttatcatattccaagaacagcccatcatagttaagctggccaaggtagggtgcaaccacgtcgtaactgcccgagaagaggtacgtggatttaaagttaccccggcagatgtgggtcgtgacggtcaagtcgcttggcaggtcagctaatgctgcgttaatcactttaacggcatcggtcgcccacttagtgtaggccgcgtggtcagcttcgggatcattgagtttgctaattaagaaagcccacgtcgtatcgtctaactgaatatagcgacacccaaggtcataaaaatgttgaatggtatcgtgataagcttgggcgagatcatttaaataggcatcccagctgtcatagaatttggtccaattgtcactccgattatcacggaataacatagttggtgatggaatcgtttgtttagcgagtacgccagcgggaacgattgattgtaagtattcaaaggcagcaaagaacggatggtcgggattatacgcgactttgccaataagttcagcgttatccgttcgagtatggtcccccttgaacttatagctttgatggtagtcgtacttgccaacaccagttaagccccaaaggaaatctaagtgccaccagctgcgtgaaaattcgccatcggtcacggctttgagcccgagtttaacttgttcagcgaccactcgtttgatttcagtgtgttggatttcaagttcttgatcacgcgtaatggtaccggcggctaattgttcatgggcctttttcaaactagcggggcgcagtaggctgccgacgacgtcaaaacggaatggggcggttaaagttgtagttgtcattaaatatcaaactccttaaattttattgggaacgaaaaaacgtcgtcctgaataatattaatcattattcaggacgacgttgggccgtggtaccacctgagttctaggctagtgaactagtctactcgatacagctgccaaatgattggcaattgctaacgcgggtaacggttgttaaaccggctttagttaatgctggttactttgttgctcaccagacactcaccaaaacgaactagggagaagaccatcttcattggttgtgccggtaccgtttcaccaacccgatactcgctgaacagcgacaccaattactcatcttttaatcgttctttaattattgacacctatcatactggtaattattttaaatgtcaaatttaatttaaggccggaatcggtgggcgggattaatccatagtcatgctataatgcaagtaacatgcgattgggggcaaattatggatagaatcattcggttttttaagcgggatgacgttgacttgtacttaacgttggcgttattaatcatcattatttatttaatgcgcgggtttgcgacagttgttctattaacgacgatttttgcgtatttgggcattaagcttagtcggtggttaaacctccgaacgcacttaccttattggattgccgtcattgtggtctacgtcggcgtgattgcgttgtttatcggtgcgctatcgtacgcggcgcctaccctggtcgatcagttgaaggtcattccagatatgctggctaaagcaatcaccaatcacccggtattgaataagaatattgataaatgggtcaaccaagccattcatagtagtgaattgattcaaaacgggaaggcgttactcgtcaccggtattaaaggactgagtgaggttgggactggttttacgcacgtcttaatggcaatctttttgagttttatctttgcagtttcgcggggacgaatgatggtctttggccgccagttcttgcagtcgaagtttaaaaagttcttcacgaacgtttactatttaacgcataaattcgttatgattctggggcggattattgaaacgcaactggtgatttgtacgatcaatacgattttgatgacgattgggttcatgattattgggatgccaagtatcatggtgttgtcgatcattgtctttatcttaggcttagtgccggtggctggcgtgttgatttcaatgattccgctaaccttactggggtttgcgtcgggtggcttgattcgagttgtctggatcatcgtgttggttattttgattcacgccttcgagtcttatttccttcatccacggctaatggcggatcggactgatttaccagtctttgtcacttttattacgttgattattatggaaagtctattaggggcctggggcttgatcattgggattccaattgtttcattcttcctagacattttgggtgtgcagaattctgagccgcgacgcgtgacgtctcaaatagcgaaacgtgaaccttagtgtgattgtaactgtactttaccggtagcagactttgtatggggtcgggtgatttatatgaacagtagcttgtgactgcgcgtaaaggttatcaaagataattgtaagctggtatcttcgaagtggattactttcgaaggtgccagctttaattaattactgcttaaagatgctgatagtgacaattacaagtcagactgttagtgttaagctatcagcgttctaggtggtataaggttgacttatttcgactaagtgttagagtgagcggttggaatctgtttaggagggggcgattacgattaatcaatcaaataatcaacatcccgtgttagatggctggcaagaaattgaagctgaccaaattaagcgaatgcaaggtgcgttgtggcatttgttgggcaatgcgatagcatatttaagtctatttgtaatcgaactagtgcttgcaacgattggtcattcgcaatctttgcacgcggatgcgtttaataattttgcgggtattgtttcatcggggttgttatcgcttggtatctggggtggcattcataatcatcaatcacatcaaagtaaagtgaccgctttggacggctgggaggccgaacgtcgcaatcgattgatgcgatttcgtttacaagacttattcacgttaatgagtggggtcattatgttagttatggcggtacaagttattgtgagtggtgttagtaatttgtttaaatcacacaccgttcaagcagtgagcggtgtaactgtttggggagctgcaatcgcgagcatcgttatgttagtcgtctggtactttaatcgtcgcggtgggcaacaattagataattcgacgctattggctgcggcaaaggatagtcttagtgatgcgttaacgagcattggcactttaatctcattaagtggggtcttactattcaaatttgcttggttagatagtgttgcgagtatcgtgattggattctttatttttgccgctgggttacaaatttttcgggacagtgggttgcagctaattaattacagtgatccacaagttgaaaaaaattatattaatacgattcaacaaattgatggtgtgaatcaggtcaatgcaattgatgtccagtattctgggagcttagtggccttgtcgctggttatagcagtgtcaccacgaatgacagtggcagccagctttcagctcagtgaaagaatcgagcaagtgatgcgaaatcagtatggcattattgacactaaggtaatgtttatgccgcaaacataagtgtgttgactgatagattttaataataaaagactagtttcaaggttgaattccttgaaactagtcttttatttatggttggcgcgaattccgttgcggcgtgcgggcatggtggaccgtcaaattcgttagtgtggcgtctgttgctggtttcgtgaacaaaggaatcgtctcttccaagacatcgctaaacgctaagccgtaccagatagcaggagatggggtgatgttttgtagtagaacgcgaccaccaattagtagtcgatcgaactggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaagttcgttgcaaatactggcaggtgatcatcgtggcttagctggatcagttgattacgataatctagcagactaatctgttcatttgcctggttgtaacgcaaacgccggcgattaccaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcaggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgactgcttcgtcaactaaggtataagagcccgtgatcaaggcctgtgacgcaatgatggctgcggccgtggctaagataatcattgcaatttgaccgcccgcaggaaccatggcatagaagggattgacattggtggcattgcgccatgccgcatcctgataatgggttaacatccacgcgccctgaccaagataattgagaatcaaagtcgtgtatacgaacggccaagtggcgtcgatgttggctttaccaacgtgacccatatcagaatacagcgcttcagccccggtcgttgcaaggaagacactaccaagaatgaaaattcccattttattagccggattgaataagacttgtacggcgtaaacgggtgagaaagctttgagaatgacgggtgcctgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagcccccagtttgggtaatccctttaagccttcgactgctgatgtgactgtcacagcaggtgttagggtgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaacactgccgataacataatcaggtgttgcattcttaagttgccccgcgtcattgatcagggcgttcataacgtatagcggtgacgttccgatgtccccgtacacgacgcctaatgtgattaacatgccaatcaatgaacgttcctgaatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtaatccggttgttcgtatttagaggataaaaaatgggccgtttcattccagttgataacgctgaaatgaagcgacccattagttttgaatttattagtctagtcaattatttctcatcagtggctgtattcgtcttcaactgggagtgtttaacggaatagccaaagtaaacgaccataccgatggctaaccataccacgaagcgaatccaagtgacaggcttcaggttgattagtaggaagacacaacagatgattgacatgattggtacaaacgggacccatggcgttttgaagggacgccgaagatctggttgtgttttacgtaaccgtaagatggagaaggaaactagggtaaaggcagtcaaagtaccgatattcaccagttcagctaagtcagctaatggaatcaagccacccatgattgcggcaatcgacccaaacaagacggttgatttaagtggtgcaccggtcttggcgctaatatcgctaaagacatgggggagtaatccatcccgcgacatggagaaggaaatccgagtttgaccgtagagacagactaacattacagtggtcataccaagaatcgcgccaaggtcaatgattccggccatccaattttgaccggagtaaataagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctggatgaaatggcgtcaaaaccgatgaaggcgaagaaaacgctagaggctgcgccgaagacccctttgaagccaaatggtaataacggactccagtttgccggtttgatgaagcgcaccgcggtaaagatgaataaaagaacaacggctaatttaatcactaccatgacgttattgacgcgtttagtttctttgaccccgagagacaataaagtggtaatcaggataataatggtgaaggccggcagattaaaatagctggtcacaccagggacggaacctgcagctgccgacaaagcagcgggcagtttgaggccgaagcccgccaagaatgattgaaagtagcctgaccagcccgctgaaacggttgagacagcgaaaaggtattctaacatcaagtcccagccgataatgaatgcaacaatttcgccgagggttgtgtaggcataggtgtacgctgacccactttcaggcaccatcgcagcgaattcagcgtagcagagtgaagcaaacaggcaagcaattgcagctaagacgaatgagatcattaggccgggacccgccgtcaaggcccccgtaccagttaaaacgaagatcccggtcccgatgatggccccaattcccagcatcgttaggtcaaatgttttaagttcctttttgagcggactgtgataagtggctaacattgcattgatatcttttttgcggagtaaccgcgtgtgtgataaatccataatcatcgccccatttcgatgtgatagctttagtttaatcggttttgacaaagttacgatggtcaatccgaccaaaataaatattctgatgggctatagtgactaaaagccaaataattggacgcaatcgcgcgacatcctgcgacttcttattgattgtctgactaatcgtgattaattagctacggtattcaacgcctattaatagggtgatatagcgaacatggcggggattgtttttctgaaggttaacttaccttgtgattgcgattgttagtggggattattgaaggaccttagaaaatatggttttggctcactaaatcgccacttgattgatgcaacctgaagaactggagagagtgagcggcttattggaacccttttttattgatatcgattatatgaataaaatgggattatgattatccttaaagtattttgatgaatcaaattggataattaattttcttgcaggtaaaacggcctacgggaaactgatgtgactcgtctcgaccttccaatatcaacatttattgaccacatttgcataaattttattattccaaatacaaacttgattgcaattctaaaattaacaaatacgaatgatattcattagttggtgacaatgggtttggcgtttgctatattcaaaaggagaacgcaaatcaaggcctgaccaatattaaaggccacttgaaattagtggactactgggtctgctgattgttgctggtatcgaagctagtgattgcaatgactggcagatcttgaatcaaaaaaggggatagcaagctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtgctttttgcaattatccttattagtagcttctgtttatacgggtacgttaaaaatcgtattgagttaaatcaagcgaggactgtactaacaacaatattaaaaagcagtccttatgacgtgcgtgtctcgagaaacacaataatcaaggaagaatccggcccttttagcggcattatttggtatgaatacacatttgcaaccagccaaacattagcggaaagtaagaaatacaaaaagtttttgcatcagtcatcaaaaaatatgaccctgaaaaattgccccatcgtctatcgcgtaatcgttagaccgccgactaaaaaaataaagcattggacgggtgaaatctatctcgataccaatcaaaaactcagcgcaacgggacgttcgaattacgtccaagctttaagcgacaagtctttgtgtgaactaacgatttcataaaaagccattaaccaggtggttccaatgatttagtttactatcggcctacattgaaaaatggggtaggtaatgcgttaactcaatcaggccatacaacagatgttcagaaggggtggtcgaatcgagttgtgttgattgtctaatcaacgcaacttttttatttgaggatttaacttggtcaaaaatatttgttatgagtttctccagtggtagcagaggtatactgcaatgattgaataaaccgatccgtaagataatgacccacaaaaaaacagctgggagacttcaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgaggccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcttttgtcggtcgtaagttaccaaaaaaccggttatttcggttacgtaaagagacgcaaattagactcgaacagatgattcagcggcaacgtgaagccctgggaacggaattgatgcccgcagatgcggtcactagttcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagagcggaaagcagcccaaggcgtcgacgttcgtgtcttgtacgatccgtgggggtcgatgggcacgttccgcagcttctttaagcatttagaagaacttggtgggcatgcccgaccgttcttgggtgctcattcagcgattttggacttccgtctcaacttccgtgatcaccgtaagatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcattacagatcgtctccagtggcccggacagtgatgcacaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacagattttcttagaagatcaaaaaatcagtagtttgattaccgttcaagactttaaaaatcaatcattctggttgaagttcaagcagacattttcacggttgttatcaccaattttataattaaacaattgaatagatgatgcaaaaaaactgattttggaaagttattgactttcaaaaccagtttttttagtgttccttagtcgttcaagtacaattggcgcaaattattaatatccgctacggataacccaagcacttctcgtaaataaccaataccattgccgtagaggtcgtcgaaaacccgaaagaccatcttcatattgtcggcttcaacagccatggcaacgttgaattggctagctaggtcaccagcattggccttggtaataatcgtagcggtatccatactgtctgcggccatgaagacggcgttagtgagcaggtagtcctgcataatcgtttcacgggggacgtctagggccgtcataatgagcgcacccgcgacccccgttcggtctttaccagcagcacagtgaaagagtaccgattggtcgggctggtcgttggtgaggagggtcgcaaataaattttgccagactttcacggcatgactatccgtaaccatttgcgcatatgtttgtgcgttgaaggaatcatcgacgaccattcgcttgatgagccgttttaaacggcgatcaaagcgacgattgtcagtgaacggatagacagacgtattaatatacttagtattcttgggataacggtctggagacatctcagcttcattggcttggcgcagatcgatatcataacggagtccgtagttatccaagtaggtgagatcgcggttagtgagtagtgacatgccaccgcaacgcagcagtttttgccacttgattgtctgaccagcggtgttctcataaccccccagttctcggaagttgatgccgtgttctagtcgtaagacccgattgtgttccatagtctgattacctcgattagtgatttagctttattataaccgctttcatttccggtgtcagggtaaagtgggtgcaaaaattagaattggatactaaaaaaactgtcagaccagaattggctgacaagtttttttaggtattagtgagacttaattagtccccgttgtaaatcgaatttttaactaccacatagtcgcacttagtaatggcctttaaatcccggccaccggcatatgagatggatgattgtaagtcttcttgcatctcgtttaaggtgtcaactaagcggccccggtaaggaaccagcatttgtttaccctcaacgtttttatgttcgcctttttgagtttcactggcggaaccgtagtattgcttataagtcttaccatcgatttttaaaatgttgccgggtgattcttggtgtccggccaacattgagccaatcatgaccatcgtagcgccgaaccgaatcgacttggcgatgtcaccattggtccggacaccaccgtctgcgatgattggtttgcgagcggccttagcacaccaccggacagcagctaattgccagccgccagtaccaaagcccgttttgactttagtaatgcaggccttacccgggccaacgccaaccttagttgcatcggcaccagcattttcaaggtcgcgaacggcggctggtgtggccacatttccggcaattacaaaactatccggaaggacgtctttgatgtgcttgatcatcgcaatgacactgtcagcatgaccatgtgcgatatcaatcgtgatatattctggcacgatttgattagtagccaggtcgtcgataaagtcatactcgctggacttaacaccgaccgaaatagatgcgtacagttgcgcggcatgcatcgtttcaataaaagcacggcgggtctcgggggcgaagcggtgcataatgtagaagtagtcgttagtggcgagccacttggcaatctcgtcgttgatgacggttgccatattggcaggcaccactggaatcttaaaacgacggccacccaattctacggtcgtatcggcttccgaacgactattaatgacacacttgttcggaattagttgaatatcttcgtaatcaaaaatctccatgcccatgatgcaaaactcctttaagttaattcacggtgtcacgttcaattagccccaaatgttgtgatcgataacgttagtttgttcgcgatcgggaccaacagagaaggtggcaattttaacgccgacgagttcttctaatttacgcaagtagttctgtgcattagttggcagttcctcaaaggttttaacgccagtaatgtcttcgtcccagccaggaagttcttcatagataggtttgcaagcttctaattccttcagactagcagggtagtgatagatggtttcgccgtttaagtcataagcggtacataccttgatggtctttaagcccgtcaagacgtctaagcagttcaaactaagatgagtaaacccagaaactcgtttagcatgccgtaatacaacgctatcgaaccaaccaatccgccgaggacgtttagtaacggtcccatattcatgggccgtttcacgaatgaaatcaccgacttcgtcaaagagttcagttgggaatgggccgtcaccgacgcgggaagtgtaggcttttaagaccccaacacagttatcgattttagatgggccaacaccgctcccaatagtaacaccaccggcaactgggttagatgaagtaacgtaagggtaagtcccttggtcaatatccagcatgactccctgagcaccttcaaataggacgcgttgaccgttatctaacgcatcattaatgacaacggaagtatcggtgacgaatggtttcaaagtttgaccataagcgtaatagtcatcaaaaatatcttcaaatttcagtggttctaagtcataaagcttggtaataatttggttcttttcagctaagttgcgcttgagtaacgccgcaaaggtgtccttatcaagcaggtcggctacgcgaatcccaattcgttcagccttatccatgtaggctgggccgattcccttattagtcgtcccaatcttgccaccggctttagctttttcttgagcgccatctaatgtgatgtggtaaggcaagatgacgtgtgcacggttagagattctaaggttgtcaggattaacgcccttgtcccgcaagtattgtaattcttcaactaatgacttgggatttaagaccacgccgttcccaatgacagctaacttatcatggaagaaaatccctgatggaatcagccgtaatttgaaagtttgcccattaaatacgatggtgtggccggcgttatcgccgccttggtaacgtgataccacatctgcttcctgactcaaaaagtccgtgatctttcctttaccttcatcgccccactggctacctactactacgactgatgccatattcttccacctcattaaatagtttaattatgaataattaatcctaaagagtagttaaacgttcaccactccaacaggaaagagtatagcaactttaacgtcaaaacgcaacccaaaagccgaatgttcttgttttgagcacaaataatcgttcataattaaggcgaattagttcgaaaacaagtccttaatatggaaacgaagtgaaaaataacagtattttttcattgttcgtctctattaattactcgaggggtatgctataataatgttcgtgttttgttagtgaatacctaaaaagaaatgaggattagcaatgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgaccagtactgacgttgtcgacacggcgcaaggttaccggttgaagcaggctaacgcgattattcgccaagacttacaagatttacgggcgacactagcacaacaagcgaaaaaatataaatatacggttgaaatggggcggacacacggcgtccacgctgaaccaaccacatttggattgaagattgcccggtggtattctgaaattaatcgggatatcgagcgttttgaacacgcggccgcaggcgttgaagcgggtaaaatcagtggggccgttgggacttttgcgaacattccaccatttgttgaagaatttgtctgcaaacaacttggattgcgcgcacaagaaatttcgacgcaagttttaccacgggacttacatgccgaatacattgctagtttggccttgattgcaacaagcgttgaagtgtttgcaaccgaaattcgtggtttgcaaaaatctgaaactcatgaagttgaagaattctttaataaaggtcagaaaggctcatcagcaatgcctcacaagcgtaatcccatcggttctgagaacgtgacggggttggcacgagttattcgcggccacatgatgaccgcctatgaagatgtgccattgtggcatgaacgggatatttcccactcttctgcggagcggatcatcttaccagataccacgattttagtggattatatcttaactcgaatcaataagattattaagacgctgacggtgttcccagaacggatgaagcaaaacatggatgcgacttacgggttgatctacagtcaacgtgtcttgctcaagttgattgatacggggatgtctcgtgaaagtgcttatgacctcgttcaaccactgacggctaagtcatgggatgaacagttacaattcaagccacttgttgaaggtaacgccgagattcgtgaacatttggaccaggctgcgattgatgatgcgtttgactatcattaccatcttcgccacgttgatgatattttcaaacgattgggattagacgattaatttaaaaacgatgaagccccagcgatggtaatcgctgaggcttttattatgattaaaacgtgttaaaaagatgggctgtttattcgtcagccgatgcgcgtcctattccggcctccagggctggggacgattactggctatttttgagcttgataatggcacggtttaatcatgcttcatactaaacgataactagcgcaatgcgtgtaagtaccttgatttcagttcaagggaccaaatgttaggtgcgtcgcaatcagaccatacccaagtgccatatgacgctgttctttgcgcgtgaggcgctgtaattgggtgtgaacgtattggtagaggtcacgatgctggcgtggtagagtcattgggaccatatagttacgataataggcttgatatagctggatggttacttgctgtggcgaaacgttgttattcaggtcgattgcagctgccagtagcgcttggcggtaggaatcggatggttgattggtaatcggctgattataagcagcatctactaaggtaaataatttttgagcatccacatccattgttaggaccaacctttcaatcgttgagataggcgcaattatagcatggtcagtatgcttgatgtgcaggcccgagttggtttctaaagtaatggaacgaacataaccagagccgccaatgagtgggggtcattggcggctctggttattaataagggattaatcaagcggcggtcgcagcagtgttttctgttttaagcccggtgccaagctgcgtagccgatggttgggaaaataccgatcaaacggtcgatttgttcgcggtctaattgatattcgatagctggcagtagtgcgttgacggcatcttcagcttgatcactgatttcagtcacgccaacgagatggccgtcttggtcatggacctgtttactagcggcaatcggttccttggagacttgataataccagtaatctgctaaatcgttatcactaatggttaagccggccttttcagcagccggtattttcatgccggcttgcgcaattcgtggtgaagtaaagacgaccgatggaattaccggatagtcaatgggagcactggtttgaccagagaacaaacgcatcaagtatttggactcaaaataggctgcaggtgtgacctttggcaagtcattggcaaggacatcaccggctgcatagatgttaggaacgttggtttgcaagtgatcgttgacataaacgccgtggcggtcatatttgacgccaatctggtctaagcctaagccatctaagtttggaattcgaccagtcgcatctaggatccagtcggtcgttaattgctggtggtcgccataactaacttggaactggtcatcctgtttggtaaatgcttgcacgttggcatttttgatgaaggttaccccacgttcggttaagtcgtcaaccacttgtgtaacgaatggttggtaaaaatcacggagggcctggtcgccatgtaacatgactgtcacttgggcaccggccgcgttagcgatggtggcaaattccataccaatatagcctgcgccaatgatgacgatactttgtggtaaccgtttaaggttcataaaatcactactatcgtgggcgagcttggtccccggaatatctaaacgatggggctttaaaccagtcgcaataacgattttttcagcggtaatggtttgctgatcatcaacgacaacggtgtgagcgtccttgaacgtggcatgaccatgaatgatcgttgcgccaccatcttccaaacgagctgtcaggcctgctggtaagggatcaataatctcttgtttatgggccacgttggccgtccaattaatggttggtgcactgctcaaaatatcattgaggcgtgctgcttcccgcgttaatttgacaggttcatcaagagtgattttggcgttacaaccacgattagggcaggtgcccccaatcagaccactctcaatcacaccgacgcgaacaccagtcttggcgagtggtgcggcgccatcaaacgtggcgtgacccgcaccaatgtataacacatcgtaatcgtatttgtttgtcatgatttatcagcctccattaaaattttggtaacttaagcttaacgagttttaagaaacctgacaactgatatgaattgctcgcgcccgctgtaatgattatactaaaagtaattatgtcaatagggagacgttaatatgcacgctttgatcgcaattgattcatttaaaaattccatcacgagcattcaggccaaccgaatagtggctaaacgatttgcggctcacggaatcaccgctactcaagttgcgattgccgatggtggtgaaggaacggtggcggcgtggctggctaaccatgctggtggacaagctattacggcatcaacggtggatctggcgcaacggtcagtgactgcaacgtatggctactttgccactgaaaaaatggcagtgattgaggttgcggctgcatccggaatccagtttgtcacgacgaccttgacgccgttagcaacgaatacctatgggaccgggctactgattaaagatgcgattgagcgtggcgcccgtcagattattctgggcttaggtggtagcggaacggtcgacggtggtgccggaatcctacgtgcgctcggttatcgtttttgggctgccgatggtcaagagttatccatgactggcgctgatttaagtcgggtcactaagattgacgatcgacatgtgttgccacaattagctgaagtctcgttcattagtgcagcggacgtgacgaatccgctaacgggaccgaacggcgcagctaagatttttggcccacaaaaaggattaccggttgctcaaattcaggttcacgatgccgctttagctcactatatgacggtcgcagctggtgcggtgagtgcccacgaaggcgatgggactgccggtggtattgggtttgcattacgttactttttacacgcccgcgtttgctctggttttcaattgttagctgaaatgagcaatcttaaaacgaaagtggcccaagcgaatctagttatctctggtgaaggccaagtcgacgatcagagttttatgggcaaggtaccaattcagctcagtcagttagcccaagcggccggcaagccttgctatttattagttggtcggcagaaaggtgcaaatgaaacatttgccaaacagggggtcacggccgttttaccgattgtcgatcaagtcatgaccttagatcaagccatggcgcagggaccagccaatctggaacggatggcggaccgcttagcccgaatcattagccagtcataaaaaacttaagcggtcaaaaaaaccgtatgcgtagtgaatagcgcatacggtttttcgactgaattttatttatcaggaacatagtgatttaaaaaggctgtaacatgtcgttgatactcggcaggatcgatccaaaaactctcggcgtgagtggcgttgggaacctgccacatctgcttggggcccttagcggcctgataattttctttgagcatccaacttgggacgtagacatccttgtcaccgtgaataaagaagatcggtagatggttatgtttgagctgttcgacagaactgacgtcgcttaaataatagcccatacggtggcggttaataaaactaacgatgggcacaaacggatactttggtaagtgaaactgtcgctttaataagtaagcgagttcttcctcgatactcgaataaccacaatcggcaatgatggccttaacttgtgatggaaggtcttcgccgctcatcatttcaacggtcgcaccacccatgctgacaccaaaaaggatgatatccgtgtgacgaccattgatacggacgactttatcgatccagcctaaatagtcgcggcgatcctgccacccaaagctaatgtacttgccggcactttgcccatggccgcgatcgtcgggcaagaggacgttatagcccatttgatggaacatataagcgtaatttgccatcgtttcaccatcacctttgtagccatgggaaacaataacggttcggttgctggttgttttagcaggaacgtactgtgcgacaaggtgattggcctcgtcattagcgttcagttgccactgctgaacgggctgtcggtgtagccaatcgacataagcgtagtaggcatcggcgtatttttgtttatctgccgaagtttcgggcacgtaatcaacacgcttgaaagcaaaatcgtagagcttctcactcgcgaatagggcggccgaaaaaattgccacaggagcactaattccggctacggcgcgtgtttttttcattaaatatcactcctctaatctctcaataatatgatacgccgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtaggttgattgttaaaaggtaactaaatcgcttacttgactggtgaaaaaactaaaaattatttgtgggtggtcaatattccggtatggacagatttcgtcgtgccaagtatgataccgattcaagtcgcattaagcctccttaagggctagttcatgcactttagtgctaacttgattaaggacctgcgttttacgttcatctgtcaaaaagacgcgctgacttaaaattgggtagtgttgttcacgtgcgattagcaataattcacgataaagcaaagtggcggctaatagcgatggccgggcgacgggatcaatttgtggcatcatggttaatgcagcctcgtacttgttcatggcaatctgtgcttcatgttcccaaagccgaataaaattggcagatgggatggggccatgcaagtcagttggattgagctgatagtgtgccaatagttttgatggcaggtagattcggccacgttggtagtcttcaccaacatctcttaaaatattggtgagttgcatggcgctgcctaattctacggctggtttgacaagtgattgcgggttagttgctagcattggcaaaatcatcagaccaaccgatccggcgacgtaatagcaatagtcttcaagtgcttgctgagtttgaggttgtttaaaagtcgcgtcttgttcttgaccagtgagcatatcgaaaaagacgtcaagattcatatcataagtctcaaaaacgacggccagtgcgcgccacattgggtggtctgggacatgaccattggcaaaggtggtcaatgattggcgcaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaagaccttttagtaattgtttgacagtacgcaaagtcagtgcgatgttgttcgaatttaggcattagtttggtcatctttaatcaactcctcaacggctaatttagcactttgcataacaatgggaacaccggccccagggtgggtgctactaccacaaaaataaagatggtcggcatagtcgaacttgttatggggacgataataattactttgttttaacgtcggtcgtaagccgaaagtggctccgttataggcgccaaactgttctttgaagtcaaccggtgtaaactgcttttcgacaacgatatgctgttcaatatcgctgaaggtagccgtttgtcttagtttgttaatgattagttgacgatagttcttcagtgttgttggtgaccagtcattaaactttgagagctcaggaactggtactaaaacatagagtgcctcactgttttcgggagctaaacttggatccatctttgatggaacatagacataatacgagggatcttctggtaacttgccgttgtcaaatagatcggcgacgtttttgctgaaatcttgtgcaaagtggatcgtgtgtaatgcttcggttgggtattttttgtctagtcctaaatacaagacgagacatgagcatgaataatccattttggcaattttttgatctgtgtactgaccacgattttgctcatttggaatcagtgtcgtcatggcggttggaaaatcagcattacataggacatagtcactgtggatcggatgattattgacacgaatgccaacagcaactttatctttgatgataatttcttgaactggtgtggcaagctttaacgtaccaccctgttctttgaataacttaacgagactattgacaactgtgtacataccaccctttaaaaaatagaccccgtagaagagctcaatcatcggaataatgttgtatagcgacgggccctggtagggagaaatcccaatatacagtgtctgaaaggctaatgaattacgtagattttcattcttgataaattttgcaatgtttttgtaggcattgttaaaggtgcgtaactgtagtcctgcatacagagcgggtaggttataaaagtcacgccagttacgaaatgatcgttctaaaaaattaggcttcgcgatggtataccggtgataaatatccgctaaaaaatttaacataccattgacgtcatcaggcgcaatgcggttaatctcggcaattaatgttgggagatcgcgtgacaaatctagactagattgatcaccaaagacaaggtgcatcaaaggttgaacttcttcgaatggtaaatagttgtgcggatcgaccccgcaaaagcgaaagacttcttcgtagatgtctttcatcatgacgatcgtcggccccacgtcaaatgtaaatccttggctaacaatctggttcattttgccacccggttgcgcgttttgctcataaatcgtaacattataacctaatttttgaagccgtactgcagcggttaagccaccaataccagcgccaataatcgatacttgcttcatcagtaaatctcccccttaacagatgaataactaaaaagcatggttaatcattagttatattttggtttaataatgtaaaaagtacaacaaatatgattactatgacgtattaaagtagtcggtaggtgcgaatagagcggacgagaaaaacaaaaaaaccaccgtatcggggaatacggtggaaaaaggagtagggtaaacatgtgacggggaatcacatgttactatgaatttcattactttggaggagtaaatgaaaaattttaggttgtgttatagctgattgagttaacctcaattgctatgatgtaatcataccgaggttgtgtgaagaatttgtgactgaacatggcgaatgtcatgaaaaaaagggaaaggctttattaagaagtgtgaagaatcatcaacgttcttacggaatgccttggcgaggtgcgatgatcgactgtttggggccaaagaaaatagtcacttcaaaagttgtcctttgaagtgactattttgattcgcaatcaatgctagtaataacaagtttgcggcgacgctaagttgatagtgaccaagcagattttggtgactggctgtgggcactgccatttggcgcgattagttatcgtcacgattaccaccgaatagaataattagtcgtagtaattgtaagaatgttgacagggctgcagcaacataggttaaagccgccgcgacaagcactttacgcaccatgggaacttcgtcgcgagtcaaaacttgcccatcagataaaatctggagggcgcgtcttgaggcgttgaattcaactggaagcgtgacaagttggaacaataacgccagtgagaagagtaaaatcccaatgtgaatcagtgtttggttgtaactcaataaaacgccgataatgattagtggtaatgataagcttgaaccgatgttcgtgatgggcacgagggcggtccgcaagcgcattggccaatagttaacgtgatcttgaactgcgtgtccgcattcgtgggccgcaactccgatggcggccacagaggttgaatctgctgtggcttctgataggctgagaatcttagtttgaccgttgtaattgtcggtcagatccccgcttatcttttggacaccaacatcattgataccagattggcttaaaataaagcgagctgcatcggtgccggttgtgccagattgactacgataggcatcataatgccggaatgtccgattaacgtaacccgatgcggccattgagataatcagtccaatgatgactaataggtaagtcggatcaaaaaacgaatagaacaaggtcgacccctcctaagtggtttaatgttaatccgattctatcagatttagcgtgacattcctactgaagaaagccattggaaagtgtctttactatcgagaaacgacgtcagattatataattagcccagttaatcgtaattggcaaagagcgaaggagttttctgatggaaaagacgtatcgaaccaaaacgtatggggaaatgccgttaaagttagatactgggaaaggctggatttttcctaaaggtgttgaagtgaaggcgcatgttgatttagaaacgggacaggtcagtttttttattgcaccagaagatctcgataagatgaaataagtattaggaccacgatacgcggtaaggttgagaagtttgtttctcgccttggcgcgttttttatggtggaaattggattggcaatgattatggttaatacggtgttcacgcgtgagccacaactacttgaaggcattaaaaaacctccgtatcggggaaatacggaggaaaagggaagtaaatcggtaaaatgtaattaagtacacacacatcattacttggggaagtaatcattaaagttagggggtcgttaaggattgggatttccttaatgactataaacatagtatagcggcgacgcgtgaagaaagtgtgacgcgaaaagtttaaaagcatgattttcagacgaaaaagttaggtcatggaacgaaaaaatatgacgatttttacaaagtttataacgaaatgatgaccgtcataaatcaatatgagtggctaaatgctggtgtgacgcagtttttattggtcctagactctgaggtgctataatgaagcacaaattaatcgaaaggtgttttccaaatatgacaattaaaatcgtcaccgattcgtcggtccaattaacgacggccgagattgcacagtataatattaaagtggttccgttactcgtggggttcggtggcgacttgattgcagatacggcagttagtaccgcggaatttgaccaacagatggcagtcagcccagtcttgccaacgactagccagccgccaattggtgatttcgtcagttgctacgatgaattgacagcggatggtagccaagtattatcactacatttgacggagacattgagtgggacggtcaatgctgctcgccaagctgccaaacttgctagtggcgatgtgacagttattgatacccaggcggctgaccgtgggatggcctttcaagtgcttacagcagcacggatggctcacgccggtgcggatatggccacaattttggcgaagataaccgtcattcggcagcatactaagacctacttgttcgtggatacgctcgacaatttggtcaaaggtgggcgcgtccctaagttggctggcatggtcacgaatttgattaaattaaaatttgtctttgaattagaagccggaaaattaaaactttatacgcgggggcgcgggaaaaaggcgctaatcaaagcgcaggaacaaattctagaccaattagcggatgcgactcgagtcgaagcggctggaatttcttacgtcggcgaaccgagcgttgcggaagcgccagaaaagcttctccaacaagtcgttccacaagtaacgccactggttgcgcgtactagtccaattattgcgacgcacaccggtgttggcgcttacgcattgatgttttatacagttgattaaatttgacgaactaacctactattaaaaattactttgatgtgttataattaattaatgataaatgagaaccgtgttggtgcactgttctgagcctaaccaccatttaatgatgactagacccggatggggcaccttttttgtcactcttttcactaaaagaaagtaggaacttatgtgagctatcttctcaataatccgtttttcgggatcggactgtcgatcttggtgtatgggattggcgagtatttatatcacaaaacaaatcgctttgtgttattccaaccgttattttttggaatgctgctcgggattggtttattggtattgattgcgtcgattctaaaggcacccgtgcaaaaagtttatgaagcgtaccaggttggtggcgactggttattctggtttgtggcgcccgccaccgtctcgtttgcggtgccactatataagcgtaatgatatctttaagaaacattgggatgtcattgtgattgcgttagcgattgggttagggctgtcattatttggtatctatgggatttcacggttgctcggtctgacggatgcagcgttaggtgccatgttagtacaagcagcaacgacagcaattgctttaccggtggctgagtcggtgggtggcgatcaagccattgcggcgttcgcagtcattctgaattcagttttgatttacgcgttaggcgaccattttattcgctggttcaaattgcacaagaatccgctcggtgccgggttaggattcggaattgccggtaatgcggttggtgccactaaagcgattgaagtgagcgaggctgcgggcgcaactggtgcaatcgcctttgtgattgccggtattcttgttaattttatggttccagggtttgcgcagttgattggtttaggttagatggtccgggagggattcgatgaaaaaaggcgcgtttattacacaaattgtgatttatggtttgattttattggctagtagtttaattgctaatttagtcaataagatttggcccgcattcccaatgccgacaccgttgattgggatgattctactatacttgctgttaacgtttaaagtggtcaaacttgagcaggtggcgggtgttagcaactttttcgtccaatttatcagcttgattttcattccatcagggatcgcgttagtaactaagttagacgtgttaaaggcagaaggcgttcagattgtgatcgtcattattgtttcgacactaatgttgttgctttttacagcgggaatcgcgtgggttttaattcaagtcaaggaatggttcattgctcgtcgaacgaacagcaatgttgagttggaagaagattaaatcttggtggcacataatttactcgtgagtagattgggtaccagttggatctaatcgaaacaggcagttgttgaaccgcttgttttggctattacaagataatagcaggccgttgtggggattgcatacccatgacggcttttttagacggcaataaaaaagccaccacatcagcggatgtagtggtcaaggagtaggaaacatcaaagtgggggctttgatgaaccccattcatcagacttgggggagtctatgaatgaaagtgattattagctgcattatggcagcaacgcactaataatcgaaaaaactaaagaatattaaggattgacagtcagttggtcactttctatcaatctgcgactattataattgcaaaagttattggctgcaactaattgagctgattaattagtttaaagtaacgcggggctggaaatcagccgcaaataagcccatgtgatagaggtcgattcgttgcccatcacgcttgatagcacgcttattggtgccctcaaattcaaaaccactattctggtaaacagcgatagcggcggggtttgttgcgatgacgtccaaacagactttgtaaagattcaattcgttaaaagcgtagttcaaaatcaagctgagtgtctcggtaccataaccatggccgcgttcgtcgggatcaccgattgcgatggctaattgggcaacctggttatgccattcgatattgaatagggtgacaaagcctaataagtggtcgtcttctaaactatgaacgtgaaagtagtattcggtattccgatcaaggttacggtaagttcgttcgagttcttcaccggtcagtggtcgggcggcagccgtatccattttacgaacaaaatcggcgtcagtgtaccagtcactgatctcatcaaaatcttctggctggggaacagcaagggccacatggggcccgacaaacatatttttcaaaataatccctcactcgtatgatgttattaaagcttatcttcatggtggcggcaaaaggtgggcttgtcaaccaaaaattatgagattacgcgtcagactagctagctcagtatgaaacacgggtggcatgtgccaagtgctgatgtcaagaacaactagctctgggggacggcgaaataagatgcggatatactgaagacttacagtaaagccgttgggcacgtgctgccgataatgtggtttcagtataatgagggcaatacgggtgatggctgaactattggtgaaaggtgttgctgtgggggcacttttcaatggtgcgtaaagagaggttagcacaaactttacagttactttatatgaagattggtaaaactttacgttagctcgctatattagagataaccatctggtgattaaagtatgagagggaggatcgaattgcgtcctttacaagttattcagatttctgatctacatttaaccccccgcggccaagtaccggcacatggtcagcagtacgatccctggggcaagcttgccaatattattgatgatattcggcgattaccaaccatgccagatttgattgtttttaccggggacttgattcatgacggtagcgctgacgattatcagcggctgcacgcaatcatccatacgatggaagctgaatttgattgtcatgttcgagttatccttggaaaccatgatcggcgagcggcgttttacgaagggtatttgccggctgacccgggaccatactacgcgagtcgcatgcggattggcaacaacgacttttattttttggattcaaaggttagcggttatgaggcaggctggttggcaccacaacagctacaatggttgggaaaacatctacgacaggcaccgacaaagcgggcttttctatttttgcatcaccccctagatgggccgacgatgacaaatatgcactatgcgattttacaaaatacgccggcgctgttatcggtgcttcggggacataatttaggcggcgtattctctggtcacgttcactttgtttcaagttatttgattggagataatattctgaatgtggtggccggttctgcggcctatgcgatcgattgccatgatccacatcatcattatgttcatgagggcagtagttaccaaatcattacaatcgatcgaggacaggtcggtgtgacaacgcgccagttactgcatgggaaagcggttattgatgaattgacgattccagacactaagtttgtcgggcgagccccacaagggtatgaatcaagatagcgctttcttaattaacaaggtataatgttggtaataattaagggaggcgtcaatatgggactatttcgtcatcacaatcaaatgccaccacggatcaaacgtaaattaaagcaacggttgttacccgttgccgccatggagattaccgcaaccacaattgtggttgcggatgtcttgacggcgaagtcatttcgccgaggacatcgacttggctggttgttattagcctttgtacaaccatttggaccgtggctctattttgcgtttggacaggaacgttagggtaattagtaaattaaagtggggttaagttcgggtgaaagctcggacttttttacgttgatgggcgttttttgcacgtttatgaatgtttttttgaatgcaatcataagcgtgtataataaaagtgtatataaagatacctataatttgaaattattatggtaatccgaatcatatagagggggactttattaatgcagcgagaatcagaattacgacaacaagctcaagaggctattaagggactaatcgtccggttaagtgggtggtctgatcagtcgggggacttattggatattattgatgtattaatgcaggtcgataaaaaaattactacgactaagaacccagaagccttagtcaatcgcctagtaaactatattcgtagtgtagccattaagggacggttacactttccagatgaagaagaaaagctaatgatcgacttaggaataatcgggcaaaaggccggattgaacggggcctatatggctgatttctctgacaagtcacagttctatggcatgctggaagaagtcccacaacattaataccggccagggggttgagggctaccggtcgtgtaattgctgattggtattccgaaagcgtcctccgattgtgatgctgattaaagcgtaagtaaaatcagcttatcgtataaattaaaaggaacacttcaggctgtgatagtccgcttaaggttgacagggactaatacaggaaaactgaaagtgttccttttgttttaggataaccagcgcgctaaatagccggttgccattgaactggttctattcactgtgcgtcaatttcaatcgctttaaatcagctgttttagttacattgagtagtttctggcagtctgggcataatccatagacttccatattgtgacccgtaaccaagtacccagagagttccgccgccttggcttcgacactgcggaggtcgggttcgaaaacgtcagtaattttaccacaattctcacaaacgacgtgataatgtggtcgtccgaaaaagtcatagtgggtgccagcatcgccattttgtaattcaattacgattcctaagtcgacaaaaagttttaacgtattgtaaaccgttgccaagctcaggttaggtaattgagttgctaattcctgatagatggtttcgacggatggatgattatggtgagtaatcaaataattaagaatgatttgccgttgcggcgttacacggattttatggtcctttaattgctgcaaggcttgggtcaacatatcttctgccacgacgcggttcctccttttatcatattcacccttattaaaccacactttttagaaggattccaatttagaaacattactagatgaaacttttgacaaaattaattaacgaaatagctgaaaaggctttactggggctgaggacgtgagtaaactaacgataattaagtgaatgtggatagaggtggtaaaatgacgcaattaattgtaccagcattaccggttgagcgggtccaatacgaacgcgcatatgtacttggccttgaagcaatgatgaaagttatccggcaacttacgactacggaaaaaggacggcaggtacccactaatcagttcccagtatttgcggcgagctatgatgttccccaagcgttggcacaagttgcagtcctaaaagccgctactactcggttgaaggttcgaccgattcagttgaccgtgacccggcagtgcgtgacgttacgattccaattacaagcatccgctggacaaccagtctgggtgccgtccgccggggcactatggcgcctatatgatggctttttaagtaatttagttgggagccctttccaacacctagcaaatattcagattggcttacagcgcgttattggaccactgacagtgactacgccaatacgccctagttttcaaaattatgatgttcgactgaccccaagtgggcaaactggttgcctagtgaaaattcacaaagcaccagcaatattggcacgacgggcaccgatataccagttaagtcattactcggaaacgattcggccggatgactagtcgtcattagctggatgattctaaataatccataatcacactgatagccagattaacggcggccataaaaaatcccaagctcatttagcttgggattttttgtggccggtatttaaggcctatcaattgacttaattatgcttggtggcgcaacgtcacattatcagttgtggctacttgagcatctgcttgtgcccacactagcagttgagcttgaatgttttccaggattttcatggataactggtagtcacgttcggacccggtgctattgaagctcaatgtacaggttccggcaaacgtgctggcggcaatttccataacgggtgagcactggaaggcacccgagaagacgcaattgacgaccgtcaagtcatgaaatttaagccgttcctggtcgacgacaccaaagttggtataccggagcgcaggctgtggtaaccagcgtttggtcattttacgcatgaccgtgattggcattgtatggttcattttctgtaaattgctaagtcgataaaggaaggcgacccgcgtacgctcgaccgttaacaagtcgtggacttgattgacgagctcactaaaaggtgcatcaatatctaccttgattgtcagaaaaacattgacggttaaattagcgatttgggtgacgttcgcatcttcagtcgtgaagcggcgcaggtcgattgggcacggcaatgtcacggttgtatgaccagttaaaacttggagtgctttagcgtatgccgccaaaatggcctcgctaataccgacgtcttgggccttagccattcgtcggacgcgcatgaattgcgtgctactgagcattacgtgaccaccgtgccgcaagttaattcccggataatggggtagtttaaccataccggtaacaatgggtgcatgaccgtgtggccgtgcaaattgacgttgcaacttagtgataactgggcgtagtcgccgttcattatgcaaattcgtgagatcggcataattgtaggcttgtgcgagcaggtacagatattctttaaacccacgattgtccgttagtaggtggctcataaaggcttgtaagacatcgtagtcaccgtgatgaatgacaaataaccgtagttgcggactattcgtaaaatcaaaatcagtgttttcaggactatacgggctttgaacttcctgaataacttggttgactggttgatcagtaacaacgaaacgattacggtcagcttgataatgaccgaaaatctcgggtacgatttgtgcggaagcgagcacggcagcctttaagcgttccacgtcgatctgactggaaaaaacgattcgcgaacgcattaatggcgcggcacctgtagtatgtagcatattcaaaaagtcaagtgcttcaccacgataatacacgattaaccccccaatcaatttctctaatcaatagtatagcagactctattcatcacactaacaatggacgtttggttttgaaaaaagttaagaaacatttgtgaaagtttattaatcctgtgatggcgataaagcactgcctcgattattatgtctggtagttatttcgatgagcaagcaataatcaggcccgctaatgaatgtctcacctcgtttaaaattagacttaagataatggcagttacgcggatgggggactggaattgctaaactgactgaatattcagcagttaagattaaaattttgatgaaagcagctggttttttgtaaccggttccgactatttgccaaaaaaggggtatactaaaagtaattacaacttaaaggagtttttcacacgatgaagattatcgcactcgtcggtagcattcgacgttcctcatataatcgtaagttagcaacgtttgttcagaaacggtatgccgatcaactggatgtcacgattcctaacttgggcgcgttgcctttttatgatcaggatatcgagctagaagcccccgcggaggtgcaagcctttaagcagacggtcatggacgcggatggcgtcatttttgtgacaccggaatataaccatagtgttccaggtgtcttggaaaatgcgattgattggctatcgcgtgttgaacgaccgttaattgggaaaccagctatgattttaggggccacaatgggacccttggggacagtgcgagcgcagagtcatttacggcaagttttagattcacccggagttgggatgcagattctgcctggaaatgaattcttgttgagcgcggtgcaggacaagatgaatgccgatggggaccttacggacaataaggtcgttgagtggttagaccattgtgtggctgactaccttaagtttgctcaccagttagccgcaaacgactaattcggataaaataattgataaggggaagtttcaaatgaacaaagaacgtaagttgatttatgttattttgaatgacgaagatgtggaatatgatcttgaagaattaccagatcaatatgtggtctatattcgccaacaagctggggattcacgcgacttgtcgttagttaatactgagattcagaacctgtttaaggatgccgaattggactttgaagaaaagatcaagcctgaaaatcggaaggctgacattgtgctagctgttaagcgcagtacggtggtagatgactaataaacaagcgtaaacaatagttgtagcggattgatgttttgccgttacgactatttttttgtgagatcaaattattggtctcaacattaatcaattcatgtgaggagggctaacaatgaccattgagacactgtatcagcagatgttagctgccatggggccccggcactggctccaagccggaatcccacctgccgagacgccttgggagattctctggggcggtattctcgttcagaataccaactggcgcaacgtggattacgcactggctaatttaaaagcagccactgactttgagcctcggcagttactagcattgactgatactgaactgacgactttagtcaaacctgcgggcttctatacgcgcaaagttccaactttaaaagccttagcagcgtggtgtggacagtatgattttgacttgaccgtgatgcgagccttgccagcagaacaattgcggcgtgaactaatcgccctgcgcggtattggcgatgaaacggctgactactttagcatgtacgtttttcatcagccaacgatcattattgacacgtatttgcggcgcctattcggctggcttaaccaaccgttaccgagcaactacttaaaggcccaacaactgattatgcaggcgtggcattatgatttaacgacggcttgggagtggcacgcactgattgttgatttcggtaaacaggtcaaaacgacggctgatttcgaacggtcctttcttgcaacgcaaagattaacacttgcttcacaaagtttggcaaactaattaaataagttcctaaattcaagtgaaccgccttaatttaatcgggttttattgaccgacttaataggggcggctattattatgtttataaaagaaagcgcttttatggttaagggcgttacttgattagttaggagggcctgacagttggtcactggatggattggcaattattagtgattttataacaaccagtgtccgaaattagtttgttaacaacgcgattattgattagtcaaagggggagaatcgctatgaagcaagtgcatttattaacgccagttgcaggacagttagtgccactcgaatcggttcacgatccggtgttttcacaagggatgatggggcaaggatttggtattgaaccgacagatggacaggtcgttgcaccaatcagtggtaaagtaacgatggttgcagcgagtctgcacgcgattggctttacggggaacaatggtctggaagtgttggttcatcttggtatcgatacggtcgaactagcagatcggccaccgtttaaagttaacgtgcaagttggtgatacggtcgaggccggcgaaaaagtggccgtgatggatttagcggcgattactagtgcgaacaaggataccacggtaatcatggccgtaacgaatacggcggatatggttaccaaactaacgcccgaactgggtgaagtccgtgccggggtcgtcggtgctgttgttgaattgaaagaacacgttgccgaagcatcggtggttaagggtaagggcggcaagtacgatgaattggcgactcaaatcattgctcaagttggtggaccggtaaatgtgaaaagcgtgattcactgcattacccgggttcgattttacttaaaggacgaagggcaggccaatgacgaggtaatccgaaacctaaagggcgttatcgatgttgcaaaggcaggtggtcagtaccaggtggtgattgggccagcggtgaccgacgtgtatgatgcaatcgtgggtcaactaggcgcaggctttggggatgctgacgcttcggctgttgcgatggagaaggaagcgaaccgggtagcgtggcagaaaatgacgctgtggcagaaggtcaaacacggttttagcagcttgattggtattattacgggatccatgattccagtgattgggttgttggcagcttctgggatcttaaaggggattttgtcgttactaaagaacttcaacctcgtctctgcgacaacgccgacctacgtgattattaatgcgatgggtgattccgtcttctacttcttaccgatatttgttggtttcaccgcagccaagaagttaggggctgatccggttatcatgggaattattggtggggtcttaacatacccagcaattgttagtatggcaacaaccggaaaggttacgggtcacttattgggaatggcaatcaatgcgaacttctttggcattccggttcacgttgcctcctatacctactcgattttcccgatgattgcgggggcgtggttagcaagtaagttggaaccatggctcaagcgggtcatcccaacagtcttacggatgatcttcgtaccgttgtttgaagttgtgattatttctggagccatcattatcatcctcgggccaatcattacagctttgtctggcgcattggccgcaggaattgtggcgatttacaaactcagtccagccatctctggcttaattatcggtggcttctaccaagtgctcgttatcttcggtttacactgggcgattattccaattgttgtcaacgatattacgacaactggacacagttacttgaatgccattgtttccgcaacgatggttgcccaaggtggtgcggtcttagcaattgcgctgaagtctaagtttgctaatattaaagaactcgcttggccagcaacaatctcagccttctgtggggtcactgaacctgcaatgtacgggatcaatctgaaatacggccgggcattcattaccgcaagtatcggtggtgctgtcggcggtttcttgaccggactgtttaacgttaacatgtggggcttcgccggatcattgatcggtgtgacctccttcatcaatcctaaggggcttgattttagtttctacggtttcttgattgcctctgctatcgacttgattgtcgcctttacgttaacgtggatgtttggcttttccgataatgatgtcaaaaacgttaagaaggcgcctgaaaagaagcaccttggtcaacaggttgcaaattagggcttaactatttttagaaaagcatttcttagggctgctcttgtaatgagggtagccctttctgtgtatttaattttaacgatgtagcgacgaaatgtttccgaattaatggcggcaatgggtgacgttaatatcataagcggccgctttatttgacaaatatatcgatatttagttaaatgtaactaataaagttacatgaaagggcgagttaaattgaaatatgcgattacaggtgctactggtcatttaggacaacagattgttgccgcgatgagaccgttagtcgccaccactgaattatatttaggggtccatacactcagtaaggcccaggtataccaacaacaaggtttgcatgttgcggctattgattaccagcagccagagcagttacgcgcatttttccaagacagtgatgtcctgatctatattcctagtaagagtcatgatagttattcgcgggtccaagaatttgagaacgtcttagcagcagtccaacaggcgaatgtgcatcatttcctagtcatgggtttcattgccgatcaggtgaataatccatttgcattatcagcattttatggttacgtgccccggcgattagctggaagtgatattaactatacgattgtccggaatgcgctttacgcggatccgttagtgccatatttgccagaattaattgaacggcacaacgtcgtttatccaatggctgatcaggccctcagcttcatcagtcaggcagatagtgcagccgcttttgctaaagtcgccacaacgcctgatttattacaacgtggtcgaatctatacgttaacacagtcccgagcttacacgatgccggaactcgccactgtgcttagtcaagtgagcgggcaattgatcgggtatcgaccagtgtccttgcaagccttcagcgatatgtacaatcagaatggtgaggggccaatgttggcctcgatgtatgccggtggcgcccgcggactattagccacagtcagtgatgattatcagctgattatggatcgtcccgcccagtcattgctggattacttacaaacaaattatcagaaaagttaattaatcacggaaaattccaagcgagttaatggttgcgacgaaattccatgctataatttatatcaatagcaactttggaaaggagtcgccagtatgactaacgggacgcgtgcagatttacgtgagctttttcataaaggacaattaactattggcattagtgaactaagcagaatgactggtgtctcgccacgacaactacggtattggcaaaaaaaggggtacattattcctaagaacgaggatgagccgggccaggctcgcgtgtatacaatgaaaatggttatcaaggcagccgcgatgagtaatttattgcagactggttataccttgaaggcggcggccgctcaggtggatgagcggatgcgaccagcccaaacaatctatcatctgcttgccgatcgttaccaaggatatgaagtggcggataatggtcagattcttgtcgacttggggccatttgatcctcagcctgaccaggaactatttgtcaaactcgtgggggataaagttaagtttgaattgaaggataattcgagaccagatagttaggcaccatttgataatgagagttaatactagactgttctgaggaatattgtaattggatagtcttagcagcgtgatttcaggataatgaaatcacgctgcttttttatgattgatatcaatagttaattaattcagtaaatgatttgtcttcctgtaagataacgcgcaaaatcggggtaatattagtcacaataggattcgagattaaacttctaaagcaatcttcaagtatatggccgacagcacaaagaataataacttatgaaaggtacactagctacaagtgtacttttatgagcttaaataatgtatacggttacattatcatatgaattgtaaaagttagggagtgataaatttggcgccgaatagttcaccagcaactcttacacgaatgattattgagttgatattgtcaaaaaggatagttcactatcaagatattatggagtatacgggcacatctcgtaagacgattgctaagtatctgaatgaggtggaaaaggtagtcaaccaacaaggtgtacaccttgttaggaaaagaggacagggtattcgttttagtggtaatacgaagggactgttggctgagtttccgatactgaaggataatagccaaagtgagcaagaacgcagaattagcattatgacattcttgacacagcaatctaaaccagtgttattagatgatattgctgaccacttctttattagtcgtagtacgttggaacgtgatttaaatgttttaaaaatggattatgggttgaagctgacggccactacagaaggtgttaaattcaatagttcggagagtgatgttcgtcgagtgattggtcagctattacagtcatattggggacaagagattaagcaaaatcaacagactggcaaaatgacacgcacatttaaagtgccgcagtccctgaaacgatatgtcaataaacaaaccttaaatcagatgcaaaaagtcctgaataaatttgtgaagattttaaaagttgatgtaaatgaatatcaatatgagtctttactgatccatacaactattgcgattcagcgaattaagaatggcgagtttattactcaaacgacgacacagaattttgacactatggcaatatctccgagtaccaacaaattagttaaaatgcttatcgtggccttcaagtgtgaaattcccgatgaagaaattgcttatttgaatatgcatgtcgcggccattgaggatgggtacattgatctggatagaagcggcttagttgaacgaacgatagtcgactggctacgtagcgtgctaacggattatgataatcagttattacgtaatctaacgctacacttacgtccggcgctggttcgcattaaaaatggcattagtattacgaatccgtattgtaatcaagttaaaacgtattttcccgtcgcttttgatcaagcactagcattagcgatggcgattgaaaagcaataccatttacagctaactgaggatgaaattgcatacttagcactgcactttgaatcgttcattgagcgccgaaaggtcttaaaaccagatgttgagcttgcaattgtatgtagcactggttatggtacggcggagttactaaagcaacgtgtcatggacaaactaccggatgttcagattgttggcactttgtctgtgaatgagttgatgacttcaacagtgactgcagacattattatttcgactatcccgttaaagatgagcggtacgagggttattcaagtcagtccgtttttgaatgaccaagaactcagcttattggaaaagttaagtcaagatattcgtcaagaaaagtatacgcggaacgcatttgttaaattattaagtccaaacggtattattacaaattcaaaggcaactgaaaaaaagatggcgattattcaactaactgatcggctagaaaagtatgggtatgttgataatcaaatgcaaaattcagcgttagcacgtgaacaagttgcatccaccattatcgataaatttgcaattccccatggtgatatcgaccatgttttgcaaccaacgattggaatcatgacgtcgaaaaagggaattaaatgggatcacgaaaatgtccatattgtatttttcgtagccctgaatcgcacggttgaaacacaaatggatgatatttacagttatttctataatttgattcaagatgggcagcgaatgacggccttaataaaggctcaaaatgctcaagaaattattgatacattagcacagcagtgaaggggaaatgcaaatatgacagaaatttttaaacagaagtatatttttttaaaagaacattttagaacacgtgaggatgtttttagctttattgcacataaagcaattgaacttggctttgcagataacgaagatgcagttttgaaagcgctgtatcaacgagaaaaagaagcttcaacaggaatgcaggacggtatagcgattcctcatgcaatctcagaatatctgcggcaacctgctgtactattcattcgctctacaataagcattcaagattggccgacatttgatgaccaaccagttaatcaggtaattgctatgctagttccaaaaaatagtgagcaggcacacttacagattctagctaactttgcgagtgcattagtggatgaccgtgagcgtcaagcattacttgaaagtcaaacagttcaggatgtttacactgtattaaccaatagttcggaaaaaattttataaaaagaggatgactgatatggattttgttgcaattacatcatgcccagcagggttagcacatacaccaatggcggcgaaagcgctagaaaaagcagcgcaggaactaggtttacaagctaaagtagaacaacagggtgcaatgggacttaaaaatgaaattacagttgaagaggcgaaaagcgcaaagtttttattgattggttcggatcaaaaaattgaaaagatggatcgatttgaagggattccagcagttcgagttgatattaatatgtgtattaaaaagccgaaagctgttattgataaggtcagcaaagcggttgctgctcgtgttaaataaaatgaacttaatgaagaatggaggagtgagttatgaagaaaatattggctgagtggaagggctacttaatgtctggtatttcatatatgttaccggttgttattggcgggtccctcgtagttgcagttcctaagttgataggtctatgttttggaattacaagttttgatgcgtataaaactggtttttggttttatatgggacaaattgaagccgttggttggattggtgttggcttagttaatttagttttggccggttacattgcatatgctattggcgataagccagctttagccgccgggttcattgggggctcattagcatctagttctaatatgggatttttaggagccttggttgctgggtttgcagctggttatactgcacgttggtgtcacaataagttacatgttggtgaaaagttcgaatctattatgccattagttgttgtaccgctgctatctacaatggttgtggcaatattgatgggagtcattttgaagcaaccgctgacttggattaatgtatcacttgtcgcctggattaaacaaatgagtacaagcggtgtaagtgctattaccttagcagttatcatgggcgctatgattggttctgacttaggcggtcctgttaataaggctgcatggatggcaggaaacgttttattagctgaaaagatttacacccctgcaatgatcgttaatgtggctattgctggtattcccttaggatatgcatttgcgacgactttctttaagcatcgtttttctgatgaattacttgatgctggacgaagcgactggttcatgggatttattggaataacagaaggtgctattccgtttacattagttaacccgttgaaattaattccaattaatatgattgctggtgctgctggttcggcgactacgattttacttggggctcaggctaagattcctcctgttggtggggtttatggatttgtcaccattacgaatggttgggcctatttaatcggtctaattgtttgcgctgcgattatcggtgtactggcaccattggctgtggactttaaccaaacacagagcgaagaacaagtcactgatgataatgaggacgacattaacattaattttgaagcttagattgactaaaacgagccgcataatggttaaagagccgtagtgcggcttttgttacctaaaataacagggagcgatacatttatgacaaaagcacattttgtaaatcatactcattgggatcgagaatggtattttacaactgaggacgcacaggtgctaagtgatcagctgttctcaaatgttttgaaggagttagaaacgcatcctgaagctaattttactttagacggacagacatcaatactagatgagtatgttgaaatgcatcccgaagatgttatccggataaagaaattaattaaccgtaatcaattatttgttggaccatggtatacacagactgatgcgatgatacctgatgcagaatcaattattcgtaacttagttattggcatcaacgataccaaacaaaagtatgggcaaccaatgatgattggctatttgccagatacttttggatttaattcgcaattgccaatgcttttaaatcaagttggcattaatgactttattttttggcggggcactaattttaagcgacaaatggactctgtttattttaaatggcacagtctaggtcatagtcaagtctatgctgctaattttccgttaggttactatactggtcaaatcgcattggattcgaagaaaaacttacaagagttcgttgcaaaccgtctagatccaggaattgattttgaaagtcaacagggtcaaaataattcggtcctagtgccttcgggaatcgatcaaatgaatattattcataacgtatctgagactattagtaagataaataaatatagtcataatcagattgtgatcagcaattatccgaagtttatgcgaacattacgacaacgcaatgatttaccggattatcaaggcgagttgcggtatccaacttatgctagagttcatcggacaattggttcagtacgttcgcgcattaaacggcagaatttcaaactcgaacagcaaatattacgacgtgttgagccactgatggtcattgccaaaagatgtggtatcgatgtgtctaagggtcttattttgaaactttggaaaaagttgctagaatgtcaaccgcatgacagtttgggtggcagtgtttctgataatgttgctattgatattgaccatcgattcaaacaaggttttgaaattgcagacggtatcgaaaactatatcaagaaaagaatcgcacaacggttgaaactggatgccaatcaggtgctagtattcaatactgatccacgcccattcaatggatataagaaaatccgtttcttaacatcatcgaaaaacattatgtttgatgaaaaatatcaagcaactattttaagtgcaaattatgtggctaagcgagaaaatatcatgcaacaaacggctaaaggctttgaatttaaagacgagcctggttactatgaattacaagtacaagttgcagtccagtttgatgggttgggctaccaagtaattgactttaaggatggtgcagaagctttgccagaattacagtctgagcaacaaacggctatccaaaatgaaagttggaaagtgaattatgtcgatggcaactttcaggcaactactaatgggaaaacttacaaaaacatcattagtattgtagattcgggtaatgatggtgatacgtacgattattcaccgcttcgaggcgacaaagaggttgacttgcctttagccggcgttgtagccatttatgttggagctggaaggcaagaactgcgattaagcggcaagtggcagttaccagaaggcttggctgacaggattagtcacgaaccaaagctgcacgatgtcgcatttgaattaacgttgactttaactgatggtgacaatgtattggcaggtcgtttaactgtcgataatcaggttctagatcatcgattacggttaaaaattaatacagcaattgaaagtgacactgcagttgcgcaagttcaaggcggctttcaaagaacacgtaatttaccaattgcggaaaattgggaagaagaatttgttgaaaaaccggttaacctttataactttgataaaattatcgggatgcaaggggctagcgatggcctgtatttaattgctaaaggaatgaaggaatacgagttaggaaagaaagcattttatgtcacattaatggcaaccactggtcaacttggtaagcctaatttactgtggcgaccaggtcgtgcttcaggcgatacaactagtattgggcatcagatgacaccaacgccgttggccgaagaattaggagcaaatacatttgagtttgggttagtttccacgtctcaattgaatgaaaataaattggcaataattgctgaaaagtggttagcacccgatgttagttatcaattacaaaaattgaatttatttgtaaatcgattagacaataaaatttgggatgttgaatttgatgattcattaccaactatctcagagtgcgagtcatttttgaaactcgatccacatgtcacaattagcacgttgtatccggcctatactgtgccaaatagttttgttatccgtttggcaaatgaatctggtgtggctgctgatttgacccccttattaaaacaacatttcattcaggtaaatgctctggaagaggctcaaccatgttcggaacaattagtgattcagccttatgatatggttaccttgctcatacacaatcagggggcatagctcatgcgtttgggaagtattgaagctggagggactaagttcattttagcaattactgatgagcactaccgtatcttgaagcgacaacgagtagcgaccacaaagccaaatgaaacgctggaagcctgtgtttcattttttaagaaaaatccagtcgatgcgttgggaatcgggagtttcggcccagccgatattaaggtggattcaccgacatatggtcagattttaaatgcaccaaaagctggttggtctcatacggacgttgtacagatgttgagggcagctttgaaaattccaattacttttacaacggacgtaaatgcttcggcttatggtgaatatatgattggacaaggacaagcagtgcgttcactagtatactttactattgggacaggcattggtggtggtgttatccaagataatcatttcataggtggtatgtctcatcttgaaatgggacatacaatggtcatacctatgtcaggcgataacttcaagggtgtctgtccatatcatcaaaatcggtgctttgaaggcatggcttcaggacccgcaattgaggctcgaactggcaaaccgggggaacaattgaagcgaaccaatgaagtatttaagttgatcagttattatattgcacagctggtctttgatgcatatcttaatttcatgcctgaaagaattgttattggtggctcagtagtaagcgaaactgaacttccagtgattagaagagacgttgagcagcttaataacaattatgttgaattaccgaacttagatcatttgattgttttaacgggaattgctaataatggttctgcaacgattggtaatgtcgccctggccaaaaatttgatattttaggtaaaaagagtcgataacaagtaacgttatcggttcttttactttactatgaatgaaaaatggtctggaatacttatttatgacttgattcatgctacagtagaatctataaggatacataatataagtctacgcttagcatagccatgattaacttaacggaggaaaatcaatgatcaaattaatcgtaagtgatatcgacggtaccctagtcgacagtcaaggacagttattaccggctacaattacgggagttcaagcagcagttgcacggggggcacaaatggtgttggcctcagcacgttcgcctaaggggatgtttggaattgcgcaacaactaggaattaactcgaccatgattgcctataatggcgcgctaacggctacgactgatgtgaatgatcgactaactgtttttgaagagcaagccgttgaccctaaactagcacaagctgtgcaaacggtagtagctcatgattggccagttgcctcaattagtatttattcgaataataactggttggtggctactaatggcccgtgggaacggcaggaagcgacgggaattggttatgcaccccatgtcacggatttgggcacatggttgcaacggatgccgacgccagtgcataaaatgatgatcatggccgatccagatattattcaggcgattgaacaacgattaagccgtaatgaatttagcggcttagcagtttatcgttcgaaagaaacttatttagaaatcgttgcggcaggcgtaactaaagcagccgcattaatgaaattattacaggatgatcaagttacccctgctgaaacgattgcgtttggcgataactttaatgatgttgcgatgctccagacagcggggattggtgttgcgatggctaatgcgccacaacccgttaaagaggcagcgaacatagtaacaactgataataatcataatggtattcagctaaccttagctcagtattttgctgatgttacgcgctaatgaaaaggccatttacgaatcattaaaaaataggaagctcaacgccatgttcgttgaacttcctattttcgtattgtagaagatatttaagagaaacctacagctagctcgttattagcgcgctaagatttctttaatagcgacgcttgcttccaatggttgacgtcctaagacatgagctaagtcggctgacttttcagccagcgcaccatcattgattggggattggaatgaggcaaacaaagcagcggtatcatgatttagaccagtcgtttcaaggaattgcacgtacgcatcctgactgacttgggtaatcttaacttggttgccagttgcttcttggagtgcttgaccgagtgcggcataagtgaggggtgtcccagcaaattcgtacacttcttgaggggcatctgccatcaaaacggttgctgccgcttcggcatattcacgttccaaggcccagccagctgtattattagcccagtacaaggtttcttggttatgggcaccactttgtaagaagcccatttcgttttctaaataccagttgttacgaagaaaactgtgcgcaatattagtcgcttttatggcattttcggtggcccgatgatcattggctaaggcgctgactgctgcctgtgcgttgggaaaactagtgtaggcgacaaatttaacatgagcggcgttaagggcagtcacgacgtttttatgagcggtggaccggtcaacgggaccaccaggttgtgatgaaacgaagagcacgcgttcaacgttctcgaaggctttcgtcattgagtcgacgtcatcgtaattcccgatacgaattggattatcaggaaacagctgagcagctttgtcctgattacgagcaattactaaaacattttctgcaccaactttagcattcagcgtactaacggcgctttgaccaaatttaccggtagcggcagtgacggcgtatttcataattaaacatcctttcaaattgctgtagcaataaaaattacagtgattagcttatcacatgtaacttcaaagtcaacaagtttgctttcgataaccgaaagactatcttcttatgctggaatataatgaatggctaagaaaaagaaaaacgagtattagtgcaagtttctgtgactaatgaagtttcatcgatgtgctaaagaatgttcttagttagttaccgctattgatttatgtccgaaaaaataggattagacaacttggtgttatctaatcctaatttataaaagtcagcgataaatggtggcgtgttacttattattcaacgacgtcaaaattcgctgtgatgcctgtccgttgaagtcattggtttgtaaccgttcaaaaacgtccttcataatgtgcattaattgttgatcggacaaaccttgggcagataatgtattgagcatgacttgcagcaagtcgattggcaggaccggtcgctgttcaggatgcgcactgaagaattcctgaacggcttggtcgtgtaagcgccagtaaactgggttttggacatcatcaaaaatcgtttttagttgctctagggccggtgatagcggaatgtttttggcaataatcgtcgttagcatcccatcacgagccggtatacgaacatccgccacgtaatcttttaatagtaagaaatgagtcttgaatggtggccgtaacgtaaaggtcatcgttaatgcaatttgactatcagtagctgccatgatgattccccctcatatgattggcagtgagtggcaaattaatgacgcttcgtgaagcggacgacggcttcgcaacgagctgtttgcgggaacatgtcgatcgattgaatatagtcgacttgatatccgcgggtaagtgcttgtaaatcctgagcaagcgtcgatgggttacatgaaatgtagacgagtttttccggtgcgctttgcaagatggcatcaattaagacgttatctaaaccagtacggggtggatcaacgaccattgcatcgggcgcaaaaccgctcgctaaccattgcggtaacaagacttccgcctcaccaacttcataatgagcattagtgatttgattgcgttgggcgttggcattggcatctgcaacggctgctggaatggtatccattccccgaacttccttagccacgtcggctagtgataaaccaatcgttccgacacccgaataagcgtcgaccaacgtctcgttaggcgctaagttcaaagcttcgcgtgctaagcgatagagtttcttggtttgctgcgggttcaattggaagaaggcccgagcagataaatcgaagactaggccgtctagctcctccgtaatagttggtttgccggccagtaatgttgtttggtcaccccagatcaatgaagttttaccagcattgatattttgcatgaccgacacgaccattggcagtttttcagcgattttcatcaataattgatgctttttcggtaacttgggtgtatttgtgatgaagaccagctgaatttcaccagtggcggccgcttcacgcacaacgattgtcttgacgatgccagaattatgttcttcatcgtaaatcggtacttggagttcctccagccaagccacgacttgacgcatgactgtcattgtcgccggcatttgcaccgaacaggtcggtaagtcgactaggtcatgactattttctttatataagccagcagcgacgtgcccatcaattaaacgaacttgaaattgggctttgttgcggtattcataaggattagtcatcccaatggtgggccgaacatcatagtgtcgataaccagctgggcggtatttttcgagtgcttgacgaattaaatcttgcttaaaggctaattgggccgggtagtcgaggtgttctaattcaaaaccaccgacttcgcccgcataggcatcgcggggatcgacccggtcaggactaggcttgcgaatactacgaatcttagcttctaggtaacgtgggtgcacggcggttacttcagcaacaacgacttcttcaggaagggtgcccttgacgaaggtgatgacgtgtttgtaatagccaataccttcaccgttaatgcctaaacgccgaatggtcagtggaaaacgctggccgatgttaacggtcgcttgcactttttcatccggctgttgtcggcgccgatcattgtgcgatcgggattggtgcgaataatgattagattgtggcataagtttgattttgacctcgtttttctgtgaactgtgttaacctccattatagcatgtggaaagacacaggataactgaggaggattgtttgaaagtcgcctaacagtcaggttataatgattctaaattagtaatcgggggtgggcatatgaattcattgattagtttagaaaaagttaattatcaaatcgctgatcaacatattttacatgatgttgattggcagattccagctggggctcatattacagtctcctattacattgacgggaccatccggtggtgggaaaagtacgttattacggatcattgcggccatgatttctaaaacaagtgggaccttgatttttgatggcagccattgaaagtatgacccaatcatgtatcggcgcaagtctcatttgtttccaacaaccgacgttatttggtgagacggtggcagataacttagctttcccgtaccaaattcgtagcaagtcatggatacgcaacgagtggtaacggcgttaaataatgttgggctgccgaacgaaccctgcatcagccgattatcgagctttccggtggtgaacggcagcgggtcgcgctgattcgcaacatcttattcttccaaaagtgtttttattagatgagtgacagctggtttggatgaaataataagcaaatcgtgcacgcctggttacgacagttaaatgagcaggatcacgtgacaacgatcatgattactcatgacgcgacagagattgctgcggcagatcaattagcgaaagtgtttgctggcagattggagtacacgcatgaatttagcagttaataatacgtcctatttttggcggcaatgttagtgctcgtcgcgttaggaattagtttgtggcagaaacttggcttggataggacatcgtcattggtgtcgtgcgggctgttgtacaactatttatcgtgggttacttgctaagatatttttccgagtcaaatttgtggctaacgctggcgatgatgggcttcattatctttaatgcggcttggaatgcgaaaaaacgggggccggggattgaccagcattagccatttcgttattagccatttttgttagtacgggggtaacactcggcgtcctcgctatctggtgcgattaagttggtgcgattaagtttgtgccatcgcaaatgattcccatttctggtatgattgcgtcgaattcaatggtcgcaattgggctggcttatcgcagcctcaatagtcagtttcatgaccagcggcaaggggtgcttgaacggttggcgttaggggctggtctactcgatgcttcgattgccatcgtgcgtgaggcgattcgtacagggatgtcaccaaccattgattcggcaaagactgtgggtctagtcagtctgccagggatgatgtccggtttgatctttgcaggggtcgatccagtacgggccattaagtatcaaattatggtcacgttcatgctcttatcagcgactagtttggggtcaatcattgcgtgctatttagcttaccgtaatttctataatgaacaaaaacagttgaagtaatgactcctgattgcagtcccgcggggagtcctttatgatggaagctgaaataaaacttaatgcgggggtattgatgtgaatgacgcagcggtttgggttccagttccagtaatgttttactggggctggttagtaccactcatatttggaaccatttttggttggcgttatcatcgcgataaggttcgcctaggtaacggtatttggttttcgctatttttctattcgtttttaaccatgctggcaattacaattttaggtagcaatattcactggttgatcattatcagtgggacgttgtttgtgtttctgatcctgttgattggactgatttttaccttacaagctttcttgctcttatggaatgcgtggatcatgtggcgtcatgagagtcatacgttggcgaatatgctgaccttgtacttgggactggccattctgattttgccatttttaggcaatctgttgagtagtcatgtgccgcagcccgtgagttattttttgacggtatttccgaatctggtcattttttaccttggtttttggttttataactatctgacgatgctgacgatttatcaattcaattggccccgtctgcgacaagattatattattgtgcttggggctggcttgttagatggagaccgtgtctcgccattgctagggcaacgaatcatgcgtggactgcgcttttatcagaagcaacaacgcaagacgcatcatcgggccgtgatgattttctcaggtggtcagggtggtgatgaaacggttccggaaggccaagccatgctggaatacgccattgcgcatggccttcctgcaacggatggctgggcggagacgcaatcgaagacgaccttgcaaaatatgcagtttagtaagcaattgattgcacagggccctgttaaaaatccacgcacgatttttgttacaaataattaccatacctttagagccgggatgtttgccaagcaagcaggtctaaaagcggatggtattggtgcgcggacggcgcgattcttcttaccggatgcgatcattcgtgagtatattgcgatatttgtccgaaataaatggtggcacgcggtggcgatgcttggtatcttgattgtgtcgctattattgacgtggtttgatgtctatcaagcatcgttatagcgattactaaggctgaatcagtaattaaaatattccaagtcaggtgtactctggcttggaatatttttttggctggaatgttaaaaatgaagttatcgaaatggcagtatacttccatttcaagccgaaaaacagaaaaatggcagtatactgccattttttaatggtggactaaatgttttaagggcaaccgtttttagtgaattcattttgaaaaaccaatttgtcttgacaattacttgaaaggtcgttatattaattatggaaacgattccaaatagggggtgagcctaaatgacaacgattagtgaaatagcagctgaggctggtgtaggtgttgggactgtttcgcggtatttaaaccatcggcctagtgtttcagttgctaagaagaaacagattcaggcagcgattgaaaaactggattacaccccgaatgccattgcgagtcagctacgcgcgcagagcactaatacgattggtgtactggtatcaagaatctctaaccccttctttgcacagttatttgatgcattggaacgggagttaaacggatacgggtttcaagtgatggtaatgcagactcatgatgatgcgttggcagaacaacactttctggataaactcaagcagcaacaagtggatggcgtcattctggcatccattgaaaatcaacaactagtggcacaattgtcggcgacgtatgctaatcagatggtgctgttgaatgaagaagctactgatattggtattccaatgatcagtttaaatcattatcaggcaactaaagatgctttggcatacttatatcatcaaggtcatcggcgaattgcctatgccacgggtggtgattttcccagtacgcatcatggacgttcgcggacgcaagcctatttagatttttgtgaagagcagcagttagttgtaaacaataactgggttttcgcacaacaacatacgattgcggatggacaagcgttggggaagcaattagcgtccttaaaccctagtgatcgcccgacagcggtgtttaccaattctgatgaggtggccgttggggtaattgatgagttacagcaacaacattttcgcgtaccagatgatatggccgtgatgggatatgacgatcaaccatttgcggcggtggcccaagttccattaacaacggttcgacaaccggtcgcggcaatggctcaattggcggtcgatcagctattacatcacttgggccggttacaacgacctgagttaacgattgatctaagcttagacttaatcaaaagaaaaagtgcttaagcctttttcttttgattaaagtggaatcgattccaaatataggagtagtaattatgcaaaaaaattggtggcaaaaagaagttttttatcaaatttatccggcatcatttaaagatgctaataacgatggcattggggatttgcgtggaatcatccaaatgttaccccggttgaaacagctgggaattacgactatctggttatctccaatatatcaatcacccatggttgataacggttacgatatttctgattaccaagctattgattctcggtttggaacgatggctgattttgatgagttgatggaagtaactaaacgattaggattaaaagtcattttagatttggttatcaatcatacctctgatcagcacgtgtggttccaatctgcaattaaatcgccgacgagtccgtatcgtgatttttatattattaggcgtggggcacacggcaatccgcctaataattggcgatcaaactttggtaaaggctcgtcatggacgttattgccaggaagtcaggatgagtattatcaccatgtcttttctaaacaacaaccggacctaaattgggaaaatccggctctaaggaaacgaatctatcaaatgattaattggtggttggcaaaaggggttgcgggttttcggatcgatgcaataacattcataaaaaaagatcaagattttgccagcattagtcctgatggtgttgatgggttaggtaaagtcaaacgtaaagctgaaaatcgacctggtattgaaaagttcttagctgaattgaacacggctacttttaaaccagctaacgcggtgacggttggagaggcttcgggggttagttatgaccaacttggacaatttattggtaaaaaaggttacttctcgatgatttttgactttcattacgcagatattgatattgcatccggatcagagtggtatcgacgagttaagtggacaccgacggacttacggcgcgcaatttttaaaagccaactggcgattcaaaatgtcggctggggagctaacttttttgaaaatcacgatcagccgcggagtattgataaatatattcagacaccagcttatcggaatgaaattggtgccaaagcactagccttactttattttaacttgcgcggttgtccatttatttatcaaggacaagagctgggggtgacaaatgcacggcgtgactcaattaccatgtttaacgacttgagcagtcacgataactatgatcgtgctattgaagagggatattcagcaagcgaggcgcttgcctttgtaaatgctcgttcccgggataatgcgcgattaccatatccatgggatgattccgtcaatcaaggctttaatcagggtgccaagccatggattacaccaaaacagtcacatgatagggtaaactggcaaagcgaacaattagattcaaattcagtttggcatttttatcagtcattgattaagttacggcaaatatcaaatttaagtcaggatttaatagtcggtgattttaggccaattacttgtgattgtgaccaagtgattgcttatcaacgtggtcgaagggtacaggtgtatgttaacttaagcgcaaaacggttattcctaacgttacctaatggccgacctcgattaaataattacgcacattatcgactcaatacgttggaaccatatcaagccattctttttgaggtgaattcaaatgagtaaaaactatcaggtacttgcgaaaaaaattattgatattgttggtgttgacaatgttgaatcggttactcattgtcagacacggttgcggtttgttgttaaagatcctaagcagattgataaagcagcacttgaagacttagatgaggttaagggagtctttttcggttcaggacagtatcaggtcattattggcactggtgttgttaacgatgtgtatgacgcaattgaaaagttacatttagttaatgcaatttatagtcaggaaacaacgactacgccgactcctgatgatcagaagtcaccattgcaacgattcatggcaatgctttcgggaatctttattccaattattccggtgattgcagctactggacttttcttgggattacaaagtgctttgactaacaatcaggttttacagttgtttggaacttcatctgccgcgattccggcaagtcttaatacagtaatttcagttttaacggggactgttttttcatttctgccagctttaattgtttggtccacatttcgctattttaaaggtacaccaattgtcggtattgtgattggactcatgcttgtttccccttcactgcctaacgcgtattcagttgcgggtggtacagcgaaagcgattatgctttttgacaggattccagttatcggtagtcaaggatccgtattaacagcgttagttgctggttttcttggaagtaaactggagcattactttcataaacacgtccctaacgttctcgaccaaattttaacgccctttttaacgatgttagttacttttggtattatgattttaggggttggcccggttgtacactggattgaaaatgtgatgattagtggtgttgaagggttgattaacttaccatttggaattggtggttttttgattggagccgcttatccgttaatggtgctagttggtattcatcagatgatgattgccatcgaaacgtcactattagcagccaccaagctcaatccgttaattactttagaagccatgtatggctttgctaatctgggggtagctttggcgatgattttacgagcaaagtcacaaaaggctaaggctaattttattggcgcattttcctcgcaactatttggtgtttcagaaccaaccttgttcggggtcttgattcgctataatttcaagccgttggttgtaaccgttttaaccagtgggataggtgctggcgtactgagtgttatgagtgtggcagcaaattcatatggtctagccgttgttccctcttatctgatgtatatttacaatgctcgtgatttgctgatttatacggtcgtctcgttattgacggtagcagtggcttttattgccactaatatgtttgcgattcctaaggacatattaaaatctgatcaagtacaaccaaagattgtggatgatacgatattttcaccagtttctggtaaaagtattgccttgagtacggttaacgatccggtctttgcatctaagatgatgggggacggcattgcaattaagccacaggaacaggggccggtaaaagtctatgcgccacaaagtggtcagatgagtgttgtagccgatacaggacatgcctatgggttaacaaccaataatggagttgagttgttgattcacatcggtattgatacggtgtcattaaaagggcaaggctttaaagttatcgttaaaccggggcaaactgttcaaaagggtgatctcttaggtgagtttgacgcaacggtgttaaaagctgctaacttagatgacacggtcatggtgattgtgacaaatagtaaaaattatcaacggatagaatcagaacctaatcagtctattcagtcgggagcagcactgctggcgattcaagggcgtccggaaatgacgactgcaacagcatcctaaacgtaagtacgataaaaccgcgatttgccatgagcaagtcgcggttttattttgaaaatttgagtaagtgcagtactagcatggactagctagcactaaccgtaatatcaccattgctggtcgtcagtcggtattgtacggccgccgattggttgacctggtaatcaccgccatcggactggagatgattgaaaatatgcaagtccccatcgctagtgctagctttaacaccggttgtccgtggcgcggttattcgaatatcaccgtcactggctgtagcggataaactttcagtgatgcgattattattgagcataatatcaccttcgctacttgttagcttaagggctttgaactgattattggttagatggatgtcgctatcagcggttataatttttgaagcagtcttggtaaaatgactgtcggtgatgctgatatctggatcgctattgatttgtagactaggcgccgagacacgagttaaccgtaaattatcgccggtcaacgtcagcgactgattgactttgacatccgttaaattaatatcgctatccgtactaagacttttcaattggtcgacggtgacgttttgcaacgaaacgttaccactttgactagctttggcggttatttgatgaatagtagttcctttaggcaccgtaattattgtcgtgtcagcaaattgtccgacgttatcgaacatgaagcccacggttttggcgttgtgtgtcgttgaagtaacagtgacgtgaccattgttggtcgtaacagttggtaaggcgcgcgtggcggtaaccgtgatattagcagctgtgccttgcttaatagtaatattgttggccgttgcaatcgtgatatcttttagctgactgacgtggtagcgccgagtcttatggcgaacaatgtgaaaaccctggtcccaatagacgctttgaataccgttattggcaattccaaacatgattagaagcagtccaacaactaataaaataatgccaactctaattgtctttcgcatggtggtgacctcctcgttccgcccgatttttcttaacaaatcggtggtataggttttgtacgattttggcaattccttgcagaataacgctaataagccagataaatagtggtaaaactaatagctcggcaccaataatagcaagaccgctacctaggtagaatagtgcgacccatagcgactggccgaagataccgatgccggctgttagcatggcaaatgcgaggatggtcacgccaattaagatggcacccgctgcaatcacgaatgcaaagacggtaacggccaaggcaaagaagaccgctaaaatagctattaatgcgggaattgtgatcggtgttgataataaagcaagcacaattagccaaatcgtgcgtacggttgcttgagatttttgccgtttagaagtattggcattgagattttcgttaaaacgaatcgaataatcggctaacactttccgagccaattgtttaggcgttcccagttcggcaacgcagtcatcataattggcgattgccgcgtctagtaagtattcgcgataaaattcaacaacctcgtcgcgttcatcatcggtaagttgaacgagtaacgcgttaaatttggataagtagtcgttcatggttcatcctccccctgaagtaagtggttaatggccaaataataggtttgccactcttgttgaatcgcactcaattgtgtcaggccggcgctcgtaatctgataatagcgtcggttgcggccttgataggcctgatcgtaagtcgtgacccagtcatttttcttgagtcgtcgaagcactgggtagagcgtcgattcggacaccgagatggcggcttgcaagcgctgcgttagcgcgtaaccatagtaatcttggcctttaaggcaggctaaaacgcacccgtccaataactcggaactaatttgaatggccattgctatccctcctgctatattatacgtcgtatagtattgctcaatgagtagtatacagtgaagtgaaactaactgtcaaacttaaatattaaaataatgataaaagttaaactacctttagccactagtaaacgcaaaatgtgcctgctaacggtgactgaaataggcccgtactaaagcttaaaatcatgatgctcagcgagtaccagctgtccggtacgcaagggtgatactatacttagctgataaggcctagaaaaatgactgatttcgatatataatcattatattgaaatattaatacagttaattgtcatggctgagttaattattatcgataatattatgacggagggcaattatggaaacggacatgaagaattgtgtggtttgtggtgaacgaattccccaaagtgcccagtattgtgaaaaatgcggcagtggacaaccgacagttgctgaggataagtgtaaagacgcggaaacgacgactttaaagcagccgcatcatcaaaaaaagagcttacggacgtggtggttttggttgccaccagttatctgtgcgctagtcattgtctttgagattggatttaatttgtatcaggctcgggaagctaatatgcttgcagccaatattcaatcagaaatcagaacgaataaagctgaatatggcaaggttaaagtgagttggaatggtggtgccatgcgtgtgcggatatcaaagcaagcgccagttattgaaagtgtcgatcaaggcaagaccgcttcgtggcagtcactagccaagacactgcaaagccgctctgaaaaaatcgcgaagaatcacaatcaaaaatattcacatattgaggttttgtcgcctaagaacaccaaatatatgtggttggaagtcaatcatggcaagatgaaattcaatattgcaaatcagttgaattagctgaccgggttcacgacataagcaatggtgtaaatggtcccggatggtttttagcaacacaatgagtgataaaagatggtcgctgaaagacgccgatacacaaaaaagcccggaaaaccgggctttttgtgactattaactggacgctatcaaatagattgcgatgattatttgtttgtgacgttaccaccaaagtatttattagacagtttctttaaggtgccgtcttgacggagttcttgaatcgctttagacagttgtttttggagtggggcgtgctttttagtgacaattgcgccaatcttttgtgttttgatttctgaaccaccactgatgaatttcaagctggcctttggattctgcttgaggtaagcatagaacgcttcccgtgagttgatcgttccggcgacgcgaccttggtttacgaggtcgatcgattgttgaaagccatcggtcggtgtgacggtcgcacctaaacgtttagcatcggtcgcgttattactagtcgttgtttgggcaactttcttgcctttgatatccgtgatcttgttaattgaggaccccttcttgaccgctaattcggatttagagtagatataaggcgtagagaagaggtatttttgtttacgttgcgcagtttcagcgatatcgttgatgaccacgtcgtatttgtcgacatccaggccagcaatcaaggagtcgaatttcgttgggacgaactttgccttgagaccgagctttttagcgacggctttaccaaggtcgacttcaaaaccagtcaacttaccgtctttgcgatagctataaggctggaaggtgccttctagcccgatcgtcaacgtgtcgctcttttgcaatttgagctgactacttgtgctagaagtgctgcttttagatgagctagaattaccgcatgccgtcaaggcgactgttagtgcgagtcctaaaattgttaaacttactgctttgagccattttttcatatcgattacccccgtagagctatatttttttgacaaaaaaagtcgtcctttatcgaaaaaggacgactgctgatcgtggtaccaccttagtttccaagcgcgtgcacaacgcttggctcaatgagctaattcactcagtacgctaacgggtacgacgcgttactggcttgctaatgctcaccaataccatttagagaccatcttcgtatcactgtccgaccgttttacaccaaccaacggctcgctttgcgtggcaatcacactactcatctcatcataatgtttagatattgagactagtctacaagattaaataacaattgtcaaatcgaaatcacattttatattaatctaaatgccatttgttgtgaatgcgccagatcgatggttgatgtgagacgctagggggtgctaaaaagaggctgtgacataactagcctctgtataagcaaatgggacgagaaaccgaattttggtttctcgtcccatttgcttacgcctttgatttttaaagttggtccctaccgtgaccag

SEQ ID NO: 732 - DNA, 238099 bp, Unknown
  Metagenome-assembled genome
gacccgcataaaggtggcatcgtgatccgtcttagagtagcgttacgtgaccatagattgcttgctgtgcttgggtgttcacgcatttatcacgtcgtttattccaacttacgtttttgtgatttacagtccggcgttgctgtttggctgggttcgggaaacctgcttatttgcttcaacggttcattaaggaccactaagtgatcctcaactgctaatcatgatatccaatagttcgggagtcagctctgatcctgccggaatttcaccgacaattttagcttcatgaagctcgcctaacaggtcaacgagttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagatcggttgtcaagtggccagttcatcaaattctaaacgacaaatcgtccggtaggacgatttggtcggcaattaccacccagctggctgttttcaggggcaaacgttcaatttttacgacctgatgaaatgccatagctgtacgctaaaaggaccagttttaacatggcaccgaggttaatttcccggacggcccaaactgtaatcatattttagttttaactctcaacaagctggtttgatgtaacgagcagaatgatgatcttctggttggtaatccaaggcaatactcaagtggtttgattcatgtttataataatcttgctattaggatgtcctttcgaggataattttctatttcgtagagtatcgggtgcgaccgatgctctttttttattttctattatatcaaaagcaggtctggaaaaatccgaagatttttccagacctgctttgtttctagagacttatgtcacagcctctaatagtggctaatccttgatggggtccttcattaataaccagagaatcaggtaagcgatgataccagggaacatgggtgtaattgctaaaacaacaaataatagccgggtaacgttagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaacggcgtagtggtaagaaccgtggtatagtaggtgatttcagtcaaagcttggtgaagtgtatgatcgtagcgtttgctcaggggcgcgttatcgataaagtgaccgttactttgaagggtttgtggtacgttaccaatgggcgttggtttagggaggacgactattcctaatcgttggagaactggaactagtgcggccgccccaaattgaccgccgcgcatattgtcagaatatgagataatcttagccggtttacgggcgccttcgaatgccaaaaaatcgaaggcgtttttcaatccagctggcattgcgtgattgtattcgggtgtcaggataatgtaaccgtccgcactagccatatcggtgagccattgctgctggttagcaggtagctcgcggtgcgggttcgccatcggtggctcgggttcgtcgaaaaggggaagttgatagttggccaaatctaaaaattggtagtgaatcgtagaatgagtcggtaattggtcaatgattaattttagatggttaaataaagcgcggccgttagcctgtgaccgggtactccctaagatgattgcaattttaaacatagtgaggcctccagatatttttattgattccaatgaatacaaaatgatagtatagacttaataatattagtatgcaagtatttattcacttgaattaaaaaggagctatttaaatgacaacaccattagttagtcagttgatgacggaactaaatcaatttttgacgcaggatagcgttgatgatcaagaaaaacgctgggccatgcaacaaacgactgatccgcaattacaagcggcattaaaacaactatcgacgacggatattaaaattatggcgtatctgggacagcacgggccaagtcgagctaagacactgccggtaccaacgggtctctcacaagcaacgatttctcgcggcttgaccaaattagcccggttagaattggcgactaagtatcgtgatttgaccaataataaagaagttctcgtacgattgacggcgctgggtgaagcgggtgccgagctgcatactcagttggatgcggcgattgcagccaaggcacaagcgattgtcgatgactactctgacgcggaactgacacgctttgttagcctcatgcgccggattcgtgaaattaagctttagcacttgatgttaccgagtgctaaattgttgcattcccacaaaatggtgttagtatatatatcgaaggtcaggaaaggtcaaacaaggatttgaattactgaccagtattaatagccaagtgaaattttgaaaggggattgttagtatggctaatactttaatgaatcggaacgatttcggcatgttggatccgtttgaacggatggcacgctccttctgggcaccattagaaaacatggatcaagtattgaagaccgacattaacgaaactgatgatcagtatcaagtgaaggttgatgtccctggtattgataagcaagatgtgaagttggattatcgtgacaatgtgttgtctatcaaggttcaaaaagatagctttgtggatcatgaagatcaagaccaaaacattgtgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcattaaatcatcagtaacaagtgagcggcccaccgataatcaaatcggtgggccgtttttgacatcaacaatcggtatgaattatgaccggtggttggtaagctgttggtttagctggatgactttgatgcgggcgagtgccatttcaattaaccatagaccgatatagactccggtgtaaaccaaggtatagaagccaaaccagcgaacgtttaatggaaaccagccacagagaatcgcaagtggggtcatccctaggtaagaacacagacaatgagcaatggtttgtttcgtaatcgaccacgtttcaatttcgaatagccagctactgaatgcccaaacttcaccaatcagaatccacaataatgtcgaaagctgggtggcggctaagggcgaggaccagtggctgacaaaagtgggattagaaggaaataaataggtggtattaaagaaggttgagaaccccaaggccattaagtagccgataacgatgtctccaatggcgccaatcaaaagggtgtgccaaagtcttttcataattgtgccgcctttccaatttgttgggtatagcgtcgtgatgcgtatgttgttgtgccagttgttaggttgacttgaaagctaccccatttggttaaggtaaaatttttaatacaggcgattcgcacaatttcactactagaaatacgtagaaattggtggggtggcagttggtccattaaagtgtgtaagtggctgtgaacgaggtaagtaccagtggttgtttcacaataaagtcgtttattgacagtgtaaaaacgtgacaccgattgaagtggcagcttaatgagcgagcgatcttgaaaaacattgatgaatcgtttcagagatggttaactggacgtgcatcgctgattctccccttaaatagcgattttgataagcttattgtagtgaaaaatgcggcttgacactagtgcttattgctacttggtcaactaaacgggctaactggtcaggaaatatgacaaaaaatttcccgggaaataattgtcactggtggtcgctaaatatgataagctaattaacggtataatacttactgaaaattagtgtcagttagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcgggttagcttttgcagctgattacgcgatttcagcaatttcggcaccactgtggggcatcattgctgataaaaaaggtcgtaagatcatgctattgcgcgcgtccctagggatggcagttgcgatggggttaatgggttttgtaacgaatgtctggcaactagttgccttgcgcgcgctacaaggtgtgtttgcgggctttatttctaatgcccaagccttagtcgcgtcccaaacgccacgtaaatatagtggacgggcgttgagcactttgatcactggtgccgttagtggtcaattgtttggcccagtgattgggggcttgctagcccaattgttttcgattcgaaacacgttttttattacggccggattattaatggtggcgtttttgttgagtctgttctttgtacaggaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgttcgtgaattgatgcattaccgtggcccgattacggttgtggccggaattatcgcagctttaccgggtatttcaaacatcttttcagcaccgcgccttggacgttatggtgatcagcacggttctggtaaggtattgttatttggctatatttttgcggtgattatgtatttcccacaaggcattgttacgagcgtcgtggccctcggtattttgcggtttgccattgggatttccgatggcgcactatatccagagattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggttagttcctgatatttggaagaacggcaaacgggcagtttcctaggtgtttggtagttagtctattaaattggctagctgccttttttgttacttgtccttgaacatgatgttaattcagtgtattgttagtttcatgaatatcgaaataagcaaacaagatcaggctgatcagcaacgagtggcgattttcaaagcactggccgatgctaaccgattacggattatccgggtgctctatcaagcacaacgggaaatgacttgcagcgaagtgggggcgcaattaaatatcagcaagtcaaccgtctcttatcactttaagaccttgcggttagtgggtctcaccaatacgcgacgaaaggcacagacgaagtatctatccttacaattagcgacctttgaccggtttttaccggggttcttagcaacgctttagtttttttgctttttagttcgacaattatcgaactaaaatcttggaaagaagatgtcaactacttatgaccacaacacatcaacatagccgctatttaacacttggaatgatgttagcggcaacgaatatgcgtttaccaattacaatgatgccgggattaatcagttctttgaaacggacactgggtttgccgagctcgatggcgggattactgaccacgatcccattattgacgtttgccattatgtccccattgattgcacattgggggcggcgatttggcaacgaactgacaatttatgtcatgttgatctttctagccgttgggagttatctgcgggtcatcccaacgattgctgcccttttcattgggacgttactagtcgggattggcgcggacggtggcaatgtcttgattccagcgattattaaagataattttccgacgaagattccagtcgcaactagtcaatacacgctctcaatgctattagtcggttcactgggaacgggactttcgggagtgttggcggcacactggtcgttaccactaacgatggcggtgctatctgtgattggactaattaatttggttgtctggttgccaaacttgaaatacaatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccatggcttctccttgattgtggctggcaatttagttacggtcatgcaattgagcggcctaccgatgtcatatttagtgccagcgacttctggtcatcggcgcggcgtttgggcaatgattatggtggtaggtgtcggttttattgcgggaattggtggtatcttactttccggaacgaatttttgggtggcagcactgtcctgcgtcttactaggattaggctctggagcagccttcagtttggcagtcgtcttctttacgcaaaaaacgaccaatgggtttgaaacggctgacttatctggtatggcccaatccgcgggctatttgttagctgcagtggggcccgtactattcggctggttaggcggtcaattaggctggggaccagtactctggttagctatcattctttccgcgttactagcattatccggcagcatcattttccagcatgcaacgatttatgagtaattaatatcacaataatgcagaacgagattggcccaagtcaatttcgttctttttttgaaactttatctttgccttagagttactctaagggattacactaatctctattcaattaaggaggccacagtaatatggcggttattcaaattctaacggtcgtcggcgtggcgatcatcggggcaagccttgtaggtgatcccactcagcaacgacagtcaaaaccagtaaaggagcaaaaataagatgacagtgttaacaacgatgtatcaactagcaaatggtgtcaacattcccaaagtcgcattcggaacttggcagatacctggtggtgaggcaacgtatcaagccgttcgtgcggccttagcagcgggataccggcatattgatactgcactggcctatcaaaatgaagctagcgttggccaggcaattcgtgattctggcattccacgtgagcaaagctttgtgacgactaaattaccggccgaaacgaagtcatatcaaggtgcactaaatgatttcgatcgctcactgaaaaatttgggtttagactacgtggatctctatttggtacacgcaccttggccatgggggcaagtcggtcgagtttacgatgaagctaacctcgatgtttggcaggcaatggaagctatttatcaaagtggccgggcgaaagcgattggtgtctctaactttgctgttcgggatttgaagaatattcttaaccaggcgacgataccaccaatggtcaatcaaattcaatattacttgggcttcacggaacctaagatcaccaagttttctgaggaacatgccatgcttgtagaagcatactcgccgttagcgacgggcggggtcctcgataatccgcaagtacaggcctatgccgataaatacggcgtcagtgtggcgcagttagcgttacgcttcgttttgcaaaatggggtcttgccattgcccaaggctgttaatccggcccatattgaggcgaatacgcaattggacttcgcaattagtgtggccgatatgcaagccttaaacgacttgccagatgcggctggttcatacatgcacaacccaacccaaggttaacgaacaaaatgtttgaccgcacttgggtcgataggagtaaactgaacataattaataaacgataaggagcgatttgatgacaacgattaatgcagctaacgcgggtacttacgcgtttgatgatcaattcaaagttaaccggatgggttatggcgtcatgcagttaacgggtcctgggacatggggaccatacgctgatcctgaaaatggggtcaaggtagttaagaaagcactggaatatggcgttaatttctttgatacggctgattcatacggtccatggtttgctgaccggtacttagcggcgggcttgaaggatgccgctaatcgtgatcagatcttcatttctgataaggtcggtcaaacgcggcaaggaccgaatgtgtggacgccacttggtgagccacggtatctgcgtcagcaagtagaagtttcaatgatgacactggggattgaccatgaagacctagtattcttacatcgaattgaccctcattactcgattgcggatcaagtcggtgaactcaaaaagcttcaggatgaaggtaaaatcaagcatatcggtctgagtcaagtaactgttgatcaaatcaaggaagcgcagcaagtcgctaagattgatgccattgaaaatctctataatgtcgccaatcacggtgatgatgacgttgttgactacgcggcctcacaaaagatggcttttctgccatggttcccattagcaacgggtgaactggctcaggctgggagtgtcctcagcacgatggcccaaaagtatcaggtgagcccagcgcaaattgccttggcctggctattgaagcggtttgataatatcataccgattccaggaacaagttctattgagcatttacgggacaatgtggcagctgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatttgggaaactggaacagcatatggtttagatatccccgttgcttactatggtgaaacgttagctgatggcacgtttaatgtgatgctggctaagtccggcaaagcagttattgagaacatgactgatttgaaggcttttctacaagatcccactgccgatgattttcaatatacaggaactattcgttaatttgaacggttagtcaaaataaaaagcgagccgtctgcatttgtcaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactagcgcaaatattaagaaagcggcaagaaaacaaaaaagttcagttcaaactagacaatcactatccaagttgtataatgtacttgtaagcgttatcagaacctaattacctattttgggggcgttatttatggttaaaagtaaagcaattatgattggtgccgggctatcaaatatggctgcggcggtctacttgattcaagatggtcattgggatggtaaggacatcacattctatggtgttgatatgcacggtgcgaatgatggtggtgccacgactgattttaccaatgagtattggaataagaatcatccgatggctaacacgactgggtatgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgatcatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagacgaaattacggtgactggcttagtcattgaggatgcgcagactggcgaaacggaagaagttgaagttgatgaggacacagcgatgatcttcactaacggttcaattaccgattcttcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttattcttaaatgaaatcgttcggatcaccacccaggaacccgggaatgcgttgaactccttcttatcaactacgccaattacgccgttgaaccaaaaggatgttaatatgtcgatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggcaatattaaggacaaggaaaaggaaattttggacagtatcgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatgctgatgatggcatgatgtaaaaacgctccccatgaaagatgactttcatagggagcgttttagtgtgcatcacgatcagtagtaacggctcgttgagacgccgtcattaacaggatcaggttgctaagcaatttagtggttgatcaaattttagcagctgctttaggtgttaatttagacggtgtgtgtttagtagtggttttgaccgtgagatgctttttggttgcaagtttgggtgcctttttagcgttttgcttggcggtctttttgattaattgtggtgccatcttcttagttttcgttggttgggctaacgtttttttagtggcgagagtcgttacctttttagttggtttgatacttgccttagggtgcttgatcgttagcttcgttgattttgccttggtggtcgtctgctttgtcaatttgattacctttttagaggctttgattttaggcgttgctttcttagcactggtggctttaggtccagcctgcttggtggtcttcttagtaattgtcaacttagtcttcggggttttcttggtcgcttttaatttagcggtcggggcgttccctttaatcatcgtggtggctttagcccagccgagggccttaccgtgttcactaatgaggtaatatgtggccgacgtatgtttgccggttgctaaagtaatcgtcttagttaccgtgtaagtctttttagtgctgagttttgctttggccgggctaacaaaggcgattgcccgatcggcggcaaagtgaattgtattcaaagtcgtggcggccttcgcgtgcattgtgatggcggggaagtgggtcgctttagtgagtgcatgggtagtggcttttggggttaccgtggcggcattagccgtggtggtcatggcaaacgggctggcagccaatggtaatgccaaagcaagtgttgcaacgactgatgttaattttttcatttcaaaatcccccttaaagtgaatcttttttgattcgaagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgaccgagattttagaactaacgttcgcactgaatgggaaagttatggtatgctagaacggtatttttactgaaaggggtgggcggcattgccggcagcaacaactttaataacccccgctgaaaatcgtttctttctgttaagtgaacgagctcgacggcggaccacgctccaacaaattagtgcgttattacgcgcacacgtaacggtaaaggctgacagtgatttcttgaaaccgactgtccgtaacttgattttacaagatcatgcacagtggttgaccgactgtagtcatgagtggcaacttttggcgagtctgccgtacgttgttaacccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacgcgttacttgatggtgattacaacagaagataacttttatgcggtggcccagtatcagacgctgactaccgctgtaccaacagtgccaacgatcatgtttgctcagccgtggctaccacaattaccggctgagcaagcgccccaagcgcgcaagttgcgacaaacaacgacgcaaaccgtcacgacgtacctaaaacgtcgtaccaagcagctaccattacaggaactaaagcccgctgaacaaacctatcagcggttagtccatgatgaacaaacggtgattgaagcggctgagcgggcggcccgtcaagcaattgtgactaatcaacaacaacgccaggcacaagcgcagcaaagtgctgtgaaggccgagcaaaccttgcgccagagtcacgcctatcaatgttatttacagcagctggcggccattattgtgatgcgtccggaacgaccgatggcgaagcaacagtttgaaaaaatcacgccaccagcgaccgaacgccctttggtgaactcttatcaattcgggcaaatggtgactgaatatcgacagactgggaagattcaagttcggcgcctagccatgcttgatcatcagttcgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacaatgccacaaactcaacagtggcttgcggacaatgcggatgccggtatgcaagcagcactacagcaacgtttggctgcgcatgaagaccgccaaccgattgcccgtgaccggatgactagatcggaattacgacagttttgtttgcgtgaacagccagctgcgccgacattagaagcatttgaacaggtctttgaccaacagtatcaattgcccgtcgaccggcaagcaacggcccatgaaacgttagcctattactatattgcgcgtcaatatcaaggtgaccatcagcgtgcgttacaacaactgaattggttattgaaagtctaaatgtttcacgtgaaacataaaaacgcccactgattttttcagtggacgtttttaattcggctgacaggttaactattaatgacgctgtgatagcgcgaggctgcaaattcatacagcggccggctaagtggtgtgacctcaacggcttcttcaaatggtgccgtaaccatggtgttgtcagcgtttttagcgagtttgacggcccaagttggatcataaagtaattgttggcctactgcgactagttcggcagtttgtaacacagtcttgacatcgtcgcgggtccggacgccaccaacaccaactagtggcaatttaccttgtaacgcttcgtgcacgtaggtcatgatggatttatcttgatactgcgggtctcgtgaaacacggtcatagttgttgagtgagacatgaacgtaatctaatcgactttcccgtagttgtgagagtaaccaaagggtatcttcaagccgaatacctggttcttcgaattcttctggtgagaaacgatagccaacgatgaagggccggtccgcatattggtcaacagctgcaaagacggcctttaataattcatcaataaagcggaaccgttcttgcggcgtgcgaccaccgtattcatcggtgcggcgattactatgtggtgagaagaactgttggatcaaataggtattggcaccgtgtaattcaatcccatcaaagccggcttgaatcgcgcgccgagttgcttcaccgaatgctgaaattgttgcgtggatctcgtcaatcgacattgctcgcggtgtttccgcatcgtcacgaagggccgcaacggcactggcagagacaatctgttcgccatttaagacggctcgatgcgtcattcgaccggcgtggaagatttgaacgatagctttggcaccttgactttgaatgccatgagcaagtgcacttagaccgggcagcatcgtgtcatgtgcgatactaagctcgccatgccaacccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatcttggcataacaggatggtgcgtgtggaataaggggattgttgctgttgttaagtcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcagagcaactaacgttaacgccagatagtcgttacgtttaaagcgttgggccatgtaccatgtgcgatgttttcccttaccgaagcgccgcaattccatcgcctgactaatggtttcgattcgatctaagcttgaaaaaatcaatggaagcagaatttgaatgccgccacgaatacgggtcataaaatgcgcttttttcgacatttcaaacccccgagcctgttgtgccagactgatagtacggtaatcagcttgaacgtctggaatgtaacgtagtgcaatcgctacggaatagctgatacgataagaaattccaatcttattgagactcgcagcaaattcgctgggattagtcgtcatgagaaaaatcagggcgagtggcacggcaaacgtgtactttaataacaaattaaattcataaaaaagttgttcggctgtcaagttaaagtagtgatcagcagatcccagtagtaagtgttcggtaccataaatcgagacgccgtaatgaggcgcaaagatgtacaccatcactaagtttaaaacggaaaaaccaataataacgttaagcacgaacgcgatatcgcggtaatgaatttttgaaaagcggaatagaatcagtgaaaaaatcatcaccccgattaagtaacgcgtgtcgtaagtcatcatcccgataactgataagccaacaaagcagagtagtttagtgctaccgctaagtcggtttaaaaaagtatgacggtcgttgtacccgatcaataattcatgttgcatcttagcgcgcctcccgttcagcctgaacaaattttgcgacgaattctgtcgggtttaaatggtgcgcttctgccagggtgtataaacttgtcttggctaaggaagcttgctgaataatggatgcgttggtcaacacatcggctgggcgagcatccatcaaaatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgttgcaagtcttggcccgcagtaggctcatcaagaattagcatggccggttctaatacgaggatggccgcaatcgtgacccgtttcttttgaccgaaactgagcgcagaaataggccagtggcgaaactcatagagaccacagaccttcagaacggcctggacacggcgctttacttcatcgtcagcgacacctcggaggaccaaaccggcagcaacttcatcaaaaatcatcgttttagagatcatttgattggggtcctgaaggatataaccaatttggtcggcacgttctttgactgattggtcagctagggaatggccgttaaatcgcactttgccgggctgtggcatcaaaaacccagtaatcagattgctcaatgttgacttaccagtcccgttttgacccactagactaatcatttcaccctgatgaagcgtgacggtgatatcgttgatgattggtttggcggaatcgtacccgaatgtcaggtgctcaattgcgagtaacggttggtcatgaacggtgggcgactgtagttgtacgccggcggtccagttttgcaacgtcgcggtgaggtcgggtacttgtaaggcttggaggttatccaagtgttggcaagttgctagatcaacaccggctagtttgagcgctgaaaggtataatggttcgcgtagcccgagttgagtcatgagtgattgccgcaaaatcgtttccggccggtcgttagcgacgatcgcgccgtcttgcatgacaatcagccggtcgattggttgctgtaacacgtcctcaatgcggtgctcaataatgatgacggtcaggtcctgcgtatgagtcagctgatcaatgagtgccatcgaggctttacccgatgccggatcaagactcgctagcggttcatcaaataataggattttactattgtcgatcagaacaccagccatggcgacccgttgcttttgcccaccagataattcctgcgggcggtgagtcaataagtcctggaggtctaaagtttgggcccactgttcagttgcttgtcgcatggccggttgggtctgctgatcattttccaatgagaaagccatatcttcgacgacagtcaaaccgacgaactgactatcaggatcttgcagtaccgtaccgacgtcttgggataatgcaaaaatggagctctcagtaatggtttgaccagcaatccttgcttggcccgttactgttcctggataggattgcggaatcaagccgttcaaacaccggcctaatgtagatttaccggagccagaaggtccagcaatcaacactttttcaccgggataaatatctagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaggtccaccaaggcgaaccataagttacgaagtcgtttaaggcgtgaccgatgaacacggctaaaccagctgcaacgggaccaaagatggcacctagtaaggctaaaaaccccatcgcgacgttaacctgggtattcggcacacccgttggaatggcgacaaatttcatgagaacaaaaataacggcggcgccgatcccggtagccacgacagtacgaattgaattggattgcttgttttgcatggtgtaacactccttaagtattgagaatgaataagttctaataaccattaataaaagcggacaggcgttaatttcagatcagttatggtcataaaaaaacgcgcctaaaagcgaatgctttctaggacgcgtttgcgtgttaccaccaagattttcccacagggacttatcatgatcgtaacggatcgctccgactgagatgggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacggaaaatcgggaacagctgattaaatggtggttaaatgcgctgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacattaaatccggtaaatatacgccgggcgaattgatgcctgaccagaataaattagctgaaacttttgatacgacacgaattacgattcacaaagccattcaattactgattattgaagggatggtttactccaagcgtggcgcggggacctttgttcgcaaggactttggcttgactgaacggcgccaagaaacgctggtagacaagccactgggaacaacgcaaacgaatgccggtaaaaaggtgacgagtaaagtgttggaattacaagctcgcttgcctactaagcgggaagcggaacagttgttaatcgatgagatggatccggtgtacgttattcggcggacccgctacgttgatggcaaggtgtgggcgtatgagcatacgattatgccaacgagtatcgtgacgttgacgaagcaagtcctcgaaggctcggtctacggttatttagagcaacatagtggcaagaaaatcgcgggttcacaccgtattatctcggcagcccgagtgacggctgatgacgttgccgcaatgggcgcgactctgaatgatcccgtgttggtaattaatcagattagttacatggatgatggtcaaccctttgaagtctccgaatcacatttcccatatgagacaagtacggtcgtagcggatgttcaaattcattaaagcaatcggtaaccgcgttaatcagtggctaccgattttttgtgggaattattctggggagttgcattcaagaaaacggtggcccataattaaattgattgaaaaagaaagcgcttcaataatctgattaagggggatgaaaatatgccagctaacttttatcaacgattaattgataagtatgaaccaatgacggaagcagcgttcttagtgttagtcagtgttcgccagccgattaccagtgaagcgattccggcaaagatcgctgaaatgaccaataatcaactacagctaggattaggaaccttatttacgaatttgcatgccatgacgaaggattatttaatgacggaacgagtcgacgaaaatgacgtgcatacctatgaaatcacggggagtggtgaatcggttttggcggctgaacgaaaacgactgcaattattgaatcagatttgtgagcaggcgggattgtaacgggttaatttaacggggaagtgagtatatgtggcgttatcaaatggcggtcaaaggctcagagcaggaattacggtggctcaatcagcaggcacaacgcgggcaattactgcggcgtatcagggggaactggtatcaatttcaaaaaacggcgacgcggtatcaagtctttagtgaatatgtgagcggtaatgttgcaactgaaatcgacgaccagcacacaccgttcaaattgttagcacggctacaattgacgaaaccagccgtacaggtgatttatacgggcacggctcagactgagttgcagggggcgcgagtggatcgtcaggacgcaccgttgcagttgaaaattgcactggcgcaacggggacacttgttaaatgttatgaatattaggttagtggttggtctgatactggccgtgatcgtgattagcctgaatgtgagtgataacgtggccagttggggaatgctagcatggttgctatttaccttctatcctgcatggcaagcaagtcggctgcataaacaggcgaatacgctgcgagtcattacgcaacaatatgatgatgcttggcggccaacgatgcacgttttcttgaaaaacatgtccaccgagctggatacagaaaaagtggcaggtctaggggcgtgggcttacgtcggtcaagatcatcacgggatgtactggtacgacttgaagacgctggcaagtgccacggaaatcaagcaatcgctacagccaattgtgggagatagcgtttctgtatcgattgtaagttggttgggattggcaccaattggatttgtttaaacttttaaaatggaagtggtaggtatgtggcggcatcgatttttgatcaaaggttctgaacaggagttggcatggctgaatgcgcaagcgcagcgacgctatttattgatggccattcatggaaattggtatcagtttaaaaaagtgccgacgatttatcgggtctttagtgagtatgtgccacaagcagtcgcggctgacatgagcaacagtaacagcgcgtttcaagttcttgcccaagtgcaagtacagcaaccagatgttcagattgtgtataccggcagcgaccaaccagcattacagcaaacgacaatggcgccaactgatcctaaggttcgtttgcaagtagctttgcagttacgtgatcgggcgatgaatacgatcaacctcagtctttatgcaggggttgtggtatggggattgtttttgatactgatccttcatcggggtgatacagatttaataggcgtctggatgctaatgctattagtaggacttctcgcggtattaggactgtatcggacggcacatcgtttgcagaatcaaatcagccagttacggcgtgacactgaacagtacgacggggcctggatgccgacgatgcacgtttttgtgagcgcattgactgctgatcttgacaccgaggaaccggcattaaagtcgttaggtcggtggaccttagttggtcatagtaaaaagggccagtattggtatgatctacaaacgctagccaacgcggcagaaatcaaacagactttacgaccgttcattgcgactgacactaacgtcaacgttctgagctggttagggctcgcgccactgggctggtttgtgtgattggcaataattgtttgtacaattaacatataaaacgttagactattctgagactaacgttttttttgtgtttaccggtctgatgataatataaatgataaaaagtgacatataatcataatagtagtattctaaataaaagacaaagctggaataggttgagtgttagttaatcagctggaaattaatggatattgtgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgcggctgtttacgggcagatgttagtcgaaagaatatttttgaaaatccgcaaacccgtaaaaatatgggacgtagtgataacttaccgctttatcagggaacttcggtcgatcgattgaaaccgaatagccggaatcggagcggggtcattggtgtttcctttgatcggtgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagatgcgtacataattagcatgccaggagactggtgtgctttttttgcgattattacccgggaaataaacgagttagattaatacccgtgaggaccgattatttgtgtttattgatcgaactagctaaaattaacaggcaatttaaattagaacggaggaactttgagcatggaaatgggattggcaggaaaacgggtcttggtcactggttcgactaagggaatcggacgggcaattgcggtagcatttgccaaggaaggcgcggatgtggtcattaatggtcgccgcgcagatacggtggcagcggttgtggatgaactcgcagcggcatacccaacaactcatccagtggcggcaccgtatgatattagtgatccgcagcaagctgacaaaatgtttcaacaaattccaacggttgacgtactggtcaacaatatgggaatctttgggccaatggcttacgatgagattgacgatgcaacctgggaacgcttctttaaagtgaacgtgttgtctggcaatcggttggcaaaacattatttacctgcaatgttagcccaagattttggacgcattatctttattgcgagtgaagaagcagttatgccttcgggggaaatgccccaatattcgatgactaaatcgatgaacctttctttagcgaagagtctgtcgaagttaacagttggcagccacgtaacggttaacacggttatgcccggctcgacattaacagaaggtgttcagaaaatgttagatgatatgtatgctgattcagatttgccaaaggatcagtgggagcatgactttatgattaatcatcgaccactatcacaaattcagcgtttgattcggccggaagaaattggtcggttagcagtgtttgtcgctagtccgtttgctagcagtttttcgggtgaagcattgcgggcggatggtgggttagtcccaactatcttctagtggctaatgaagacgatatatctttctggttctgccatagaaattcagatgtcaaaaaactgttttagcgagtaaagtttatcgccaaaacagtttttttgttgacttgactatcctcagaagccagtttcaagcggattagatgtttaaaataaaatttttaactgattgactggctagtcattgacttattagtcaacggcgcctatgattgcagcatcaacaataagatgctcgaatttgaaggatgggagtgagtcatatggataaagaaccgttattaaggattagtcacttgcaaaagcatttcgggaagtttcaggctctcaaggatattaattttgaaatcaacgcgggggaagtttttggctttatcggtccgaatggtgctggtaaatcaaccaccattcgggtactacttggaattttaaaagctagtggtgggcaggcgacgatttttggtcgcgatgtctggcgggatagtgtggcgattcataagcgaattgcttatgtgccaggcgatgtttatttatggcctaatctaagtggtggggaaattattgacttgtttcttaaactaaacggtggtcagcatacggctaagacggacgcgctaattaaacaattcgaactggatccgcgtaaaaaagcgcgcacttattctaaaggtaatcggcaaaaggtggccttgattgcggcactctcaacggatgctgatctatatatttttgacgaaccaacgtccggactggatccgctaaatgagcagacgtttcaaaatgaagtattggctttaaaacggcgagagaagagcgtcctgttatctagccatattctgtcagaagtggaaaaaatgtgtgatcgcatcggtattatccgtgagggacagattgttgaaacggggtcgttagctgagatgcggcacttgacccgaaccacggtcgatgtgcaaacacgactgcctttgactgacttgaccaccctagctggtgttcacggggtcacagcgcgccacggagataaccacgtcagtctagccgtcgatgctgaccagttgacgccggtagtgcagtacttggcgagtcggaaactgatcagcttaacaacgaccccaccaacgttagaagatttattcatgcgctattacacgaccgaacaacaaccggtgaaggggaagtgatgctgatggcaacacaactatttgctcgtaccggattactgatacggttcaacttacgacgagattggaaaaagttgctcatttgggtcgtcgtgttgacggggctattcacggccatcgccgcgaagtttgatggtatttatggcactcagatggcactgaatgaaattgtcaaaacgcttaaaacgcccgcgatgatttccttatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttcattggtctgggcttagggggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggcctgtatgtattactgggtcttggttgttcaagtttggctgcagctcttaatgcttatcgggacttgggcgcgggcttagtcgaaccacggcgcggtcggcgacaggctagtggtttattgcggggtcccgtgaccctattatggcggcaggcacatggtctgattattgcatggctactagggaactttatcttaggtgccgcgtatgcgtccgtctttaatacgattggcgatctggcaaagagcaatccaatgatcaaacaactgctaggtgcgtcagctttagcagcagcgaatcgcttgatcgtcaaaaatttcattgctgtgttggctatcgtcatggtgatcgttgcactggttccagcagtacagttaatgctcaaactggtcaatgatgaacaaaaaggctatctacatcaagtttatgcgacggccacatcacgttggcacgtgtgggcaagctataccggctgggcaatcgtaacgggactgctcgttttacttgccggtctaagtggtatgtatttgatgggcctgacgagtatggtcaagcccatcagttgggtgacctattggcacgtgtttgcggcctatgcaccggcgatgttagtgatggtagcggtgacgagtgccttagcgggctggcgacctaaatggcggtatgctgcgtggatctgggtattttacgccttcttctcattgtatcttggtaatttgattgatttgccaaaatgggcacgccgtttaacgccccttggctttgttaacaaggtaccaatcaagcccttagatggaacgacaagtagctggtgcctattattaactgtgctaatattagtagtagcagcactaagttatcggcggcgtgatctagctcagtaaacgaaaggagtgcgtgacatggcagtaaaacaacctgttcctaaagacccggcgaaggtcgagcgtattatgcacgcggccatgcacacctttgccgtcagtggctatcgagatgctaaaacggatgtgattgcgtccgcggcaacggtgtctaagggcctattatttcattattacggtagcaaacagcgcttgtatttggccactgttcagcttgctactgacacgattattgccaccattaatcaacaagtttttgatgttccagatgacctagtcacgttgatggtgcggagtgcgcgttacaaggcggcgtttggtaaagaccacccggatgaaatgaaggtcttgattgacgcctatggcgcgctggagcgcttgccggtaaagatacaggcacaaatgaagatcctgtatactaagtcgatgactatttcccgggaaatgatcagtcaggtgctggataaaatgacgctgcgtgcggatgttgatcgtgatgcaacgattgctttgattatgggtgtttacaatcagatttttatggaatttcagacctatatgcgtgagaatcatcaagttgaatcgatggccgatatcgaatgggtggtcagtcgcgcaaaaacctacatggggattttagaacatgggtttatggcggcggatttagatgaccagcagtaataatacgtatcttagacagccgacggatgtttaatccggacgactgtttttcgaccggtggattcggcagcgtttaatagtgataatgtttattcgcttttttcgttagcaggctaaaaatgtggtaagttagacttaatagatgacggatgaagtgagggatcggaatggaattacatttaacggcacgacagacgggattgtggcaacggttgatggcactggcacgtgagcaattgatgggactcgccatgcagatggagtcgactgggaaagtcgatcgaccgacactgacaacgcttgcccagcaattggctttggacgatccactaccagatgaccgcctgagccaacgggttttgagtacattagcgctggcgcaaagttcagctgggctcgctatgagttttgccagtagttggcaagttgaggatgcaatattaacgtttggaaccccgcaacaacgccaacggtattgtgcacaatcaggtgtttttggactcgcggcattaccggaacaagtcatggctagtagtaccgtcaaagcaacgccggtaacagctggctggcaactgtccggtgcggttaaaacggtattgaatgttacacaggcaactgagtatttagttctcgcacagacaccaccgaatgctacaggggcctttgttattagtgctgatcagccaggcgtcacggtcagccaaccaataacccctttagggctacacggattgaccatcgcggatgttcaactcaccgatgtcccggttacggccgctgatcaaatcggtcaattgggacaaggacaacgagtgatgcaacgggcgcaaagcttggggcaattatttgccggggcgattacagcgggaatatggcaacatgccacagaccaggcacgacagttagcgctgacagaacagccgccgttaactgccttggcgccagcaatggcgattacggccgccttacagactagtgtctacaatgcggcccaacaggccgatgatgagcgcccatttacagacgcagcgcaattggcggcaatgtttgccagccaaaatgccttggcgccgtttaaaattttgataccattgatcggtgatctagcctatacgcaacactcgccgttaagtgccttgcaaaatgacgtggcgacactaccgttgattgttggcacggatacgcaattggcgttgacttttgccacgacgagcctgaatgacgaagtggccgatgtcccgacaacgggaccccacacagctcctgagcacctagtcgtggccgacctacatcgggtcgtaaaacgcttgaatttgactagggatgtgccagtcaatgtcggcagtattgctacggcgaaacgcgtcgtggcattaggtcgaggcgcgatggaaccggcagtattgcttcaagcccaacaattggccaagtggattggtgcagcattggctgttacccagccgctaacggctatggaacaatttagcattgagcaacaaattggtgcctcagcagtgacggttgcaccagaagtcttgatcaacattggcgtcgctggtgatgatgattacttggctggcatggctggtgcgcaacacgttctttctgtgaatacggatgaacaagcgccaatcttcaagcattcacaacaaattttcgtgggcggtgccgctgaatttttggccggaatggtggcagcattaaattaatacgaagtcgagttcggcactgttggtaggtctgacggggtcgtatgacaatcaattgtttgcacaaaaactaagggtcacagcaatgtactgtggcccttggttttttacttagctttaaattaagtaccaccagtcattacttaattaacgaaataattaatgaccaccgtcacttaaaacgtgcggtgagctggttcagaatcggaatcttaaatagggcaatcaagataactgagtagcagacgtaggttatgacttcttgtatcatgcgcgttgttagcaaaactgaccatggtgttaagtacatgagatgaagccagaggctgtttaaaaacaaattgagaataaagacgacgataaagttagcgacgagaacgcgcgtcagtgaagtttgatgttgaaaggcgtatccaaagactaacccagtcagaaaagcggttaggataaaaccaggaaaaaaggtgaactttgggaagagcagcattccgagtagggaggaaatcgcgctactgccggctgtaactagtggtgaaaataaacgggccgttaaaccaataataataaacgcgaaggatatcttggttagcaatagttgaattgacagtaaactccctaagataagttgcatggcaattaaagcaccgagtaacgggatacgccgaaccgtgagtgatgatgtcataataattgaagccccctaagtgtgttgaatgtattttaggggaatttgttgagaattactagacctgaaattattggttataagtaatataaaaatatcgctaggagaaacgctatgacgttatgtagcgtttctcctagcgatcaattaatccggaatatggctcccgttggacatgggttgcagttatcgctacaatgttgataaaaggcagtatggaggcgtttgaatggcatacattacaaaaaagaaaattgcacaagcctttcatgacgtcgtcctagtgaggggctttagccgaacttccgtgacggcaattatgagcaccgccgattttagacggcaaacattttatgattattttcaagataaatatgaattattaacctggtttattgatgacaccctgactgaaacggttgaacataatctgaattatttgccttggatcgacattattaaactagtttgttacgagttagatgcgaatcgtcaattttatgcagaatgtattaacacgcagcatgaaattgacgtgacggcacttgtcggtaaccacttagccacgttattgactgaactaacgcacgccaatacaacagaaacggcggccctaatctggttgctgtgcttgggaatcgcacaatcgttaacgcataatatcgttgcgaatcatcctgaagattatgaggtgctttctcagcacgctattgcggccatcgaaatgacactcgaaattttgaactagttaggccaagcagcagttttgacgggtcggtttagagcagttaaccagtcagggtcggctaggctgagtaaggttaatgacaacccatgcatcccgttagcagttaaaaaagttcccactttgttgaagtcgattgttagtgcggctaaggtgagtaattcgtgaacatcattattgaacaccatgagttccatgggcgttgtcccaccgagggagttaacgaaaacggcgtaatggtcgtcagcatgccacttaaagttgagacgtaatttactaattaattcctgtgcgagtcgttctgacgattgaaaaggttcacgccgataaccgggttccccgtgaataccgataccgtaataaatttcaccaggattcaagttaaacgatgccgttgactgtcctggaatgcgggcgccgctagcagcaaccccaatcgtgtgaatgtttggcactagggcggcagcgatgtgggtcaattcagcgatagaggccccctgagctgcagcggcaccaagaattttatgcactaaaatcgtgccagcaactcctcgtcggcgctgttttaaagattcatgatccacggaaatatcgtctgccacaatacatagaccagtttgccaatgttccttttgcagttgttgttgagcagccgtaaacgcactaacatctgctggaaaatttttaacaatgaaaaaaacgcgacgctggcgtgtcacctgttttgtgactttaacgatttcttgagatgtagggggttgaaaaaccgttcccatgattgcggcagttaacataccaggcccaacataaccccagtgtgccggatcgtgaccgctgcccccaccagcaattaacggaatctgatcatcttgaaagttgctgtcgtaacatccgaatgtatttggtacccatgttaaatttggataggcccattgaatgccctgagttgcttgactcagggcattttgaggttcattaatgatttgcatgggaacaccttcttatattgttaatttgattttattataacgcattcgaatgaccatgcttgtcagaagctggcggacaaaataacgaaactgtccattatttttgaaagcggattcatttacaattaacgtgttaattcgagaaaggaaggacaacaaaaatgaaaaaaataattaatgatcccaagaatgtcgtcgacgaaatggttgatgggttagtacgtgcctatcctcagtatttaactaaattaccggataccgaagcaatggttcgtagtgatcaagattcaatgcagggaaaagttggaattgttagtggtggcgggagtggtcatgagcccgcccacgccggctttgttggccctggcatgctcagcgctgccgtggcaggacaggttttcacctcaccgacgccagaccaaatttatgcggcaattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgctgttaaggatagtttatatactcagggtcgtcgcggggttgccggcactatctttatgcataagatacttggggcggccgcggatcaaggcgttgatttggatgatttagaaagtttagcaacgcatgttttaccacggattaaaacgattgcggtcgcattatccgcagcgacggttccggaagtcggcaaacctggctttgaattggcagatgatgaaatcgagtttggcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggtatgggagcgacgccattgatggatcagtatgtcttttgccatgacttgttggatgaactggcaacacggcacattcaaccggcctttatgaaggttggtaattatatgacttcgattgatatggccggtatttcactgacgatattcgatgttgctgaatctcaatggctagattacttacagtacccggtcaaaacaatcgcgtggtcataaggaggaattgagaatgttaacagttgagaacacaacagtatggctgaataagtttgctgatcagattgaacaacaccaaagttacctaagtgaattagatacgccgattggcgatggtgaccatgggggtaatatggctcggggcctagcagcagttaaggcagcacttgccacgcaaccagcagacataactaaactatttcaagcaacggcgatggcattgattagcaaagtcggtggtgcttctggaccattgtacggaacagctttcttagaaatggcaaagcaaagtaagattgatagcgatttaggtggattgttggccgctgcattagctgggattgaaaagcggggtggcgcgacaaccggcgataagacgctgattgatgtgtgggcgccggttgttcaggcggtccaagcgggcgaattgacgcaggatgttatcgatgatgcagttgctagcaccgaaccgatggtggctaaaaaagggcgagcatcctatctaggtgaacgttcagtgggacaccttgatccaggtgctgtctcgagtggttatttatttacaacgttactggatacggagggaatcttatgagtttaggaattgtagttgtttcacacgtcccagaaattgccgcaggtattcagcgtttgttagggcaagttgcccaggacgtttcgattacgattgctggtggtacggatgacaatcaagtcggaaccagcctgaccaaaattacacaagcgtttgatgcaaatcatgcggatgaactcttggccttttatgatcttggtagtgccaaaatgaatctggaaatggccattgaaatgagtgataaaacggtccatttatatgatacggcactcattgagagtgcctacacggccgcatcgctattacaggcggctgtgccacttgcggatgtcgaagctcaattagcgccattaaaaatcaagtaggatggtgacgaaacatgcacggttttttaggtgaatttttaggtaccatggtgttaattgtatttggggttggtagtggtgccgccatgaatttaaagggtaattatgcacgccatcagaattggacgtttatttgcttggcgtggggcctagccgttacgtttggggtctatgttgccggacaatttggttcggatggtcatctaaatccagcggtgacagttggttttgcgttattcggttatttgccaatggctaacgtttggccgtacttattaggccagttcttaggggcctttatcggcgcggtaatcgttattattcagtactacccacactttcaagctgccaaaacggcggcagatggcaatcaagttggcatttttgcaactggtccagccatcagtaacccggtatttaattttctaagcgaaacgattgcgaccttcttctttatcttcgtgttgttgaatctcggtaactttacccagggattaaagccattgatggtggggctgctcattgttgtcgttggtcagaccttgggtggaaccacaggctttgcgattaatccggcgcgtgattgggcaccacgattagcctacacgattctcccggttcctaataaagggttggctaattggggttatgcctgggttccaatgtttggtccattgcttggtggtattttggcagctggtctggaaacaattattagttaaatactcacaactgtgccgattttgttgggcgcagttttttgttataaagtataattaaataaataatgcaagtttatgcaatcgcttgcaataacgatgaaaacgttttatatttaatgagatggattcaaatagatcggggggatcatgatggcaacgatcaaagatgttgcccagcgcgcaggtgtttcgccttcaacagcgtcacgtgcaatgcatggtagcaagattatcagtaagccaacacgtgacaaggtcattaaagcggcgcgggagttaaattacgcgccggattttaatgcgcagaatttagcaactaaggctagtaatacaatcggggtggtactaccagtagatcatcacgaaatcttttctaacccatttttcttagagatgattcggggtatcaatgaagtttgtagtaagaatggcgcaatgacaacgctagcaacggggatttcaagtgatgaactggtgcataatattgatgtcatgattgcacaaggccatatcaaaacttttattttactgtattctgaaaaaaatgacccagttgttgagcgcttgaagcaatttgatgtccaatacgttgtgattggtaaaccttaccaagacgtcaataaaacatcgtatgttgataatgataatatccaagccggaacggatgcagcccaatatctaattgatcatggacaccggcgcattgggtttttgtattcggatttatcacggatggtgcaaagtgatcggatgcttggctatcaacgtgtaatgatacaaaatcagttaccaaatattatgttggaagaacggtttgagactcatgcggcgggtgttaaaacactacataagttttttgaacagtatccagatgttaccgggtttgtggccgtagatgatatgttggcgttgaaattacaacaggttctccataatgatccgaactggaaagttaaacaattctcactgattggttttaataactccattttttctgatttagcgcacccgatgctgacatcgattgcggtctttccacagcgtttaggtgaagaagcggccaagattgcgatggctgaccatcctgctgatgaattatcaacggcagtaattgtgcctcatcaaattgttaaacgccattccgtccaccaaatcaagtccttacagtagtaagttaggggggtattttgattatgataacgctaaacgatgtcgcgaaaaaagctaatgtctcaaaaatgacagtttcacgagtcattaatcatccggaacaggttcgtcctgagcttcgagagatgattttaaatgtgatgacacagctagactatcatccgaatgcggcagcgcgagcgctagtagggcggagaacccgggttgtaaaattaacgatttttgaagacatggacacgacggaaccctattacatgatgttgctcgcggggattgcgaatgaattgaatcaacatcaatacgccttgcagattgcgacgcgcaatagctatgaggttggcgaatgtgatggctatattttgactggtattcggcaagccgattacgcatgggtcgaacgtcttaatcagccagtcgtctttgttggtagcaatcgtcagggatacgactacgttgatactaataattatcaggcggtctgggaaagtacacgttatgccgcggaacagggctatacgcatcttgtctttattggtatcgctattgccgaaccgtttgagctagatcgtgaacgaggttttcgagagtacgtcacgacacatcatattagcgctcagattattcgattagccaatcattcacacgttgcaactgcgtatgtgaagagccattggtctggttttccacgtaatacggcgtttatttgtgcaagtgatcggttggcgatcggcgttgaaacggcaattattaatcaaggtggtcgcgttcccatagaatatggcattatcggttttgatggcgtgttattaaatcagattgcagccaaacggttgacaacgatgaagcaaccgcttgaagcaatgggacgagctgctgcacggctattattggctaatatcaaccatactgatcgttctcgcgggcggcatgatcaagaaaaaatcatcattaattcacggttgtcggtggctgaatcgacccgttaaagaggagtctggatagatgagcaagcattggtatgatcaacaaacgatttatcaaatatatcctaagagttttaacgatagtaatcacgatggcattggtgatattccgggaattaccgcgaagattccctatttgaagcaacttgggattaccacgatatggttaaacccaatttatcaatcaccccaggttgataatggctacgatgtttcggattactaccaagttgattcgagcttagggaccatgacggacgttgagacgctcattaaaacggtccatgagcacggcatgtatcttatctttgactttgtcttgaatcatacttcagatcagcatccatggttcaagcaagctctcgctgatccacagagtaagtatcgggactactatttatggcaagatcccgcagccgatggtgggcgcccaaacaactggggctcatttttcggtggcagtgtttgggcgaaggatccggcaggcggctcacagtattatttccacttgtttgataaacggatgccggacctcaattggaagaatccggcagtgcaacaggcgatgcgtgatgttgctgagttttgggttgaaaaggggattgatggtctccggttagatgcgtttattcatctggctaaagcagattttcgccaaacttatccaaatcggactggtgattcgacacccatcattagcgatatgttttatgcccacttaccgaaagtgcatcagtacttacacgactttgtcgccgtaatcaaagctaagcacccggatacgtacgtcgtcggtgaagcgtcatccgctgacccccatttgatggtcgactatacgacaccaggtacggatgagtgtgatcaagtgattacgttcagaacttttgcggacgacaatacccaggatgatccgagcttctccgacacatttcagccccgaccgatggatgtgacggcctataagcaaaatacggtcggtattcaagcggctttagcagacaccagtctaccaacactttactggaataatcatgatatggctcgggtcgccacgcgttacggtgatcctgattatccgcaagcaagtgccaaggcgttagcgacggccctgtatttgcagcgtggcattcccattatttattatggggaagaattaggattaacaaatatccgttatcatgatattgcggactttgaagaccagacggtacccacctttgttgcgagcgctcaagccgctggtaagtctaaggtggaaatcatgcggatgttgaatcaaactcataaaatggcggggcgcggccccatgcaatgggacaatacggtttatcatggtttctctgaccacttaccatggaaacatggtgatactgatgacatgaatgcgcaagcagaaatcgctgaccccgacagtatttatcactattatcaacagttgctgcagctaaagcagtgcgcaccctttactaatggtcagttcattatgctcggaagtgctgaacaactctttacctacctcattgatgatggtcaaaaacaagcagcgatagtttgtaatttaagtgcgcaagcgcaaacgtatctgttgccgtttgttggtggtaaagtgttgcttgtacagggtggtgcaacatataggggacgccaagtgacgttaccagcttggagtagcttagtcgttaaatcggcataagcaatgtgagtgcatgattatcctaaaattggtatatataaatcatgtgatgtattttaattaacttatcaatctttatataaattggtataaaggttgatggaccaataaatcctaacgtttttaagcgttaggatttatttttggtatgattctgttaacgttaacattacgaaaacgcttgcgaaagcgtttgcacagttgcataataaattatggtaaatgaattaagatacttcgcaaggaggaagcactatgagtacttggaaaaagttggggatgggtgccctagccactggtttagcactcacgctcgtaggttgtggtaatagtaaatcttcatctagtagttcaaagatggacaagacgttaaaggtttcagcggatccttcatataagtcatacatgaaatcggtgattccaaagtttgaaaagaagtacaacgttaaggttaaggtttcatacaaggccatgcttgatgaagacgatgctttgaagctggatggtccttccggcaagggtcctgatgttttaatggcaccatacgaccgggttggtcaaatggcgtcacaaggtcaactatcaacagtcaagttgaccagtggtcgttacaacgcaacggggaagaaatctgttacttataagaataaggtttatgcagcgcctgtaacgatcgaatctgacgttctgtactacaacaagaagctaatcaagactgcacctaagaacttcaaggaacttgaaaagttagcttctgacaagaagtatgcttacgctaatgataagactaagtcagttgccttcttgactcaatggacaaacttctacaatgcctttggtgtcatcaaaggttatggtggttacgtctttgctgatggcaatacgaacgccaagaagatgggcttgaacaattctggcgccgttgaaggtttaacttacatgacgaagtggtttacgaagtactggccaagtgggatgcaaaatgtcacttctaacgaaaactttgtgacctcacaatttacgtctaataagactgctgctgttattgatggcccttggatggctgcaacttacaagaagtctaatatcgattatggtgttgctgttttacctaagttgaataacggcaaagattatcaagcgtttgccggtggtaaagcttgggcaatctcaaactactctaagcataagactgctgcacaagcttggttagacttcatctctaacaagactaaccaaaacaagctttacaagtctgctagtgaaattccagcaaacacagctgctcgtaaggaagctgtaagtactggcgatgacatggctacggccgtttcaaagcaatacgacaaggatgttcctttgatcaacttaccacaaatgtcagaagtttggacaccagcacaaacgatggttaccaatgctgctagcggcaagatgacaccaaagcaagctgctaataaagcgcaaaagacgatcttaactaatatctcacaaaagtatgataagtaattaaaattgtaatttaagggggctgaaacaaaattcgttttgtctcagcctttttaaaaggaaaaatgcacgatatttagaatttatttaggaaaggggtgcgggcgacatgcaagtcaaggatgtaaagaaagcgcaacgcctgtcaattattcccgggctcggtcagctgtataacggtcagaccataaaaggtgttggcttcattattattctattggcatttattgctgagttcatcttcgggggctttagcgcatttgccaatttagtcacattgggttcagtctcaatggaagacaactctttgttcatgatgatctatgggacgttgcagattctattgacaattgtgtttatcgtattttatattgcaaacctttacgatgcgaaacacgttgcacagttaattaataatggtaaaaaggtctcccatacgtttaaagagttaggtgcgagtttagtagatggtggctttgcttatttattaaccacaccggcctatattttaatggtttttacgattgtgttcccagtattggttacactactgatggcttttacgaactatgattttgcgcatattccaccagctatgttattggattggattgggttcaaaaacttcacatcaatgttcttcttgagtagttaccgggcaaccttcaacgctgtttttggttggaccgttatttggaccgtatgtgcaaccacgttacaaattattattgggattgccaccgcagtaattgctaatcaaaacttcatcaaaggtaagcgcttcttcggagtgattttcttgcttccttgggcgattccagcgtttgtatcaattatgagtttttcaaacatttttaatgattcagctggtgcgatcaatgtgcaggtcatcggcttatggaatacgttagttccatttgctcacattgcgccgatccactggatgacggatacgttctggactaaagttgctattattatgattcaaggttggttaggattcccgtacatttacgttatgattactggtatactgcaagcgattccagaagatctctacgaagccgcaacgctagatggtgcgacagtaatgcaaaagttcaacaagattacgttgccaacgatttttgctattgcagcgccaatctttgtgacgcagtatacgtttaacttcaataacttctcgatgatctatctgtttaaccaaggtggccctggtgatgtcggtgctaacgccggtgggacggatatcctgatctcatggatctacaagttaacaacggggacgtcaccacagtattcattggccgcggccgttacgttgattatttccgtcttagttatcgggatctcattgattgtcttcaagaagacccacgcgtttgaaatgggggactagtgttatggataatgcacaagcagtggcacctaagaatgccaattcaaagcaaaatagcgcgcgtcggcaccgtttctggaaagaattctttacgtatctgtatatggtcattctcggaattattattatttatcccgttttgatcacattcatcacggcgtttaaggatgctaacgtgcaagccttcgtccttgattttggtggtaagtggacgttggttaactttaagaacttatttacgcaaaccctgtatggtagctggtatttgaataccatgattatttcagtctcatgtatggtcattcaagtcatcgttgtgacgttagccggctatgtttatagtcgttaccgttttgctggtaaaaagttcagtctaacgtttttcatcgtaattcaaatggtaccaaccatggccgctttgactgcttactacgtcttagctaacatgttgaacgctttggaccattactggttcttgaccgcaatttacattggtggtgggatcccacagaacacttggctgatgaaaggttactttgacaatgttccgtatgatttggatgaatcagctaagttggatggtgctggtaatttcaagattttctggtcaattgtcttaccattagttaaaccaatgattgcggttcaagcgttatgggccttcatgtcaccagttcaagattacctgatggcgaagttcttattgacgtctgaatcacattatacggttgccgtagggctccagacattcattaataacgctcaaaatcaacaagttgtgctcttctcagcgggggcaatcttagtcgcgttaccaattgctgccttgttcttctacttacagcggttcttcgtttcaggattgctcgctggtggcagcaagggttaactcaaatattagtaggggtgaaattagatgcagagtacgaaaaacaaaacaaccgcctttccggtccggttttttggcagcctcttctcacctcgaagaatgtttgccaaccgtgatcagtttaattggttacagattattgttttatttatctttttgaccgcggtaatggtcatgccgattccgttttactataatcaccaaacgaattttaatctgtcaccatttttaccacacattgataaaatgatggtcagtgatcagatgcaaacggcaatgaaaactgcgaactaccgtgatcagcggttcaaggatgtcaaacatcaaatcattattaaaactaaggataatgttgcaggcttcgatctcacgaacgatgatatggcaggacgcaagaatgtcattaatttacatgctagtacgtttcaagtgaaatcggtcggtagtgaatttaaagccaagtatgtgccaggccataacttaaagacaaacgctcatgcgtttctggttaattcttggtatcaaagcaataaagtgatgattggtctatttatgctcatggcacttggattaattattgtgggggtcaacctgatcctcgtaaatggggcggcgttcttcttattcttgtcacgacataataagatcacgcatattcggaatttccgcgaaggcgttaacttaacgttgatgatgatggggattgggagtctgttagcgatggtgattggcttaattcattttgatgtcactatcgaattgaccgtgcagtccctcagcttggccttcgttgtgttgtgggtatatctgaaaacaaaattcaaagatccggaagttgaccaaaccatgttgctttaggtcaattagtaagcatagaaatgaggaagattaatggcacgcgatacgcaaacgcaattacgcaatgagatgatttactcagtctttgttagaaactactcagaagctggtaattttgctggcgtaactgctgacttacaacgaattaaggatttaggaaccgatattttgtggctactgccaatcaatccgatcggtgaggtcaaccgtaaggggacacttggttcgccatatgcaatcaaggactaccgtgggatcaatccggaatacgggactttagctgactttaaagcactcacggatagggcgcatgaattaggaatgaaagtgatgttagacattgtctataatcacacttcgcctgattcagtcttagcaaccgaacatccagagtggttttatcacgacgcggatggtcagttgacgaataaggtcggcgactggagtgacgttaaagacttagactatggtcaccatgagttgtggcagtatcaaatcgacacactcttgtattggagccagtttgtggacggttaccgttgtgatgttgcgccattagtgccacttgatttctggcttgaagcgcggaaacaggttaatgcgaagtacccggaaacgttatggttagcggagtcagccggcagtggttttattgaggaactgcggtcacaaggctacacgggtctgtctgacagtgaactttatcaagcttttgatatgacatacgattacgacgtcttcggtgattttaaagattactggcaaggacgcagtacggtcgaacggtatgttgacttgttacaacgccaagatgccactttccctggtaattatgtcaagatgcgcttcttggaaaatcatgataatgcacgcatgatgagcttgatgcacagcaaagctgaagccgttaataacttgacctggatcttcatgcaacgtggtattccgttaatctataacgggcaagaatttttggccgaacaccaaccatcattgttcgatcgggacaccatggttgcagatcgtcatggggacgtgacaccactgattcaaaagctagtgactattaagcaactaccattactgcgtgctgcggactaccaattggcagtcgtagaagaaggtatcgttaagattacttaccgtgcggctggcgaagcgttaacagcctggattccgttaaaaggtcaggtcacagcagttgcgactaagctagcagctggtagctatcaaaatctgttaacagatggtcctactgaagttgtggatggcaagctgacagttgatggtcaaccagtattaattaaatatgtcaccaatacggcggtgactaaagttgctgaccagtccaattagctgattaatagctttgaataatcgatcaaaaagcaaccgtttgcgggcgattgcacgtgtaatagtagtttagaagtgagaaaacaagggagtggatttcgatggttgaaatgaatctcgatcacatttacaaaaaatatgagggtaacgataaatattcagttaccgatatgaatcttgatattaaagatggggagttcatcttcttcattggcccatctggctgtggtaagtcaacgacattacggatgattgctggcttggaagacatcactaagggtgacttcaagatgaacggtcaagttatgaatgacgtggaaccaaaaaaccgtgatatcgcgatggtttttcaaacttatgcactatacccgaacatgtcagtctttgacaatatggcctttggattgaagattcggaaaacttacagtaatactgaaatcaaaaagcgagtggataacgctgctgagcaattgggcttaaccgattatctacaacggaaaccagccaatttatctggtggtcaacggcaacgggttgctttaggacgggccatcgtccgggacgcggggacgttcctattggacgaaccgttatctaacttggatgctaagctacgggtcgatatgcggactacgattgctcaaatgcatcaacgcttgaagaccaacatgatctatgtcacccatgatcaaattgaagcgatgacgatggctgatcggatcgtcattatgaatgacggtaagatcatgcaagttgggacaccgcacgaattgtataacgaaccggttaatcaatttgtggctggcttcatgggatcaccttcaatgaacttcttcaatgccaccttacatgatggtcgggtaactgatggtgagggactcgacgtagctgtcccggaaggtcaattgaaagttttaaaggctcaaggctatgaccagaaaaagatgattgtgggtatccgaccagaggacattcatgctgagcaaattgcgcttgaagcgatgtcagattcaattgttaagacgaaggtcgtcgtttctgaattcttaggtgccgaaagcatgttatattgtacagctggcaaatctaaatttactgcccaagtggatgcacgtgattatcataacccgggtgagaatgtggaagttgcttttgaaatgtcgaaggcccacttctttgattctgaaactaaagatgttattcggtaatttcgaacgacggaggagcaacaacaatgaaacgtatttttgaagtagatccgtggcacgtcattagtcatgaactcgtaccgacggataagcgattgcaggaaagcatgaccagtattggtaacggctacatgggtatgcggggaatgtttgaagagcactattctaacgataccctcaaagggatttatatcggtggggtctggtatcccgataaaacccgggtcggctggtggaagaacggttatcccgattatttcggtaaggtgatcaattcggtcaatttcatcaaagtcaatatcacgattgatggtgatcaagttgatttggcgaaggacacagtcagtgactttacgttggatcttgatatgcatacgggaattttacggcgttcatttattattaccaagggtgaaaaacgcgtccaattcatgattgatcggttcgtcagcgttgcacaaaaagagttatttgatgtgcactatagtgttcacaatttgggtgcggaaccggtccaaattggatttatttcgcaaattgatgcggacgtcttcaatgaagatgcgaactatgatgagcagttctggcaagtgctagacaagagtcatgcgattactggtggcagcatgtttgcagaaacgaagccgaataacttcggaacaccgcgctttacgctcggcatgcagatgcttcatgaaacggcttttcgaggtattaacgccccagaaaccgaaaaggcagttacaaatatcttccggggaacgttagcaccggatgaaaccaagaattttgaaaaacgagtcctcgtggtgacttcacgggattacgcggatatggcggcgatgcggactggcttagccgaattaagtgaaacggtcagcacacagtcatatgaggacttacggcaggcccatgttgatggttgggctaaacgctggcagttatctgacgtgttgattgacggtgacgatgcggcacaacaaggcattcgcttcaacttattccagttattctcgacctactatggcgaagataagcgcctgaacctggggccaaaaggctttactggtgaaaagtatggtggtgcgacgtattgggataccgaagcgttcggagtaccgttctacctttcattggcgaaaccagaagtaacggagaacttactggaataccggtataatcagcttgctggagctttccataatgctaaaatgcagggcttggctggtgccttgtacccgatggtgaccttcaacggaattgagtgccataacgaatgggagattacgttcgaagagattcatcgaaatgggtctattgcgtatgccatcttcaattacacacgttataccggtgatgagatctacttgaagactaaaggaatcgacgttttgacggggatttcacgtttttgggctgatcgggtccacttctcagaacggaaacaacagtatatgattcacggtgtcactggtcctaatgagtatgaaaacaacgtgaataacaattggtatacgaactttatggcgcgctggacgttagaatacacgttagcgagtttgaagaaagtggatgccgctaagcgtgcagcacttcaaatcacggatgctgagcttgcaaagtggcaagatattgttgaccggatgtacttcccgtatgatgaaaaattaggaatcttcgttcaacaagatggcttccttgataaggacgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgatttctatgaaccgttgaccgtccatgaatctagtctttcaccagccgtccatgccattctagcagcggacttgcattatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtgcctaaagcgtggacccattatcaattccacgttaacttccgcggtcgcttgattaaagtggatgtcgatcaacagggtacgaccgttgaactggttagtggggaaccactgactatcgaacttaatgggcaagctatcgaggtcgctagcaccgtaacaactaagtaaatatgaacgcttgattgtggtctgaccgtaactggccacaatcaagtttccaacctaagaatgagctcaattcattccaacctaacttctaaatcggtccgtatcagctgatacgggcctttttagtgtctggacataaaagagtccctcacttggaaatatcgatttccaagtgaggggctcggctgttctattcaaatagcatcggtagggttatttgagtgtttgcgtcaatcctagcacgtccatttcgtaaatccgaacggcggtgtcagcaacttgggttggtttatcgacgactaaccggacgtagcgcgccgaagtagccgcgaaagtattgagactagtggcttgcgtgttattgtaggtccgggcaacgtccgtgtagcgtttgccatcagtgctgacctgaatggtccaagcgcgggtgttcatatcagcaccttcgccaccagctttggcatgcgctaatttaaccgcactcacagtcgtttgacggcctaaatccagcgtcaaggtatgcggtgccttaccggttgcacaccatttagtatcgagtttcccatccaccgccattttaggtgcttcactactattcgtgtatccggaggcactggtcttggcgttcttggatagtaaggttaaagcgccttgagctttcggtgtaatcgtaatgagctttttcattgtaacgtgccgttggccatccttatttttagcggttaatgtgacgttataagtgccagccttacggtaagtgaccgtggggtttttggcggtgctggtcgtctttgtggcaccgtcaaattcccatttatagctggttgcgtttttggatgaggcatttgtaaacttgatcgtgttaccgggagctgccagggtgcggttaaccgtaaatgccgctttaggtttacgattatccggccattttaaggtaacttggtcagaagcatcgccacgttggttccaaatatcaactggaacgaccatcagattggtctcgttgtgctgcccattccgtttcaacgcgtttaaatagaaattagtcgtgttagtggcccccagaaatgagcgagaaccgtcattgttaacctgataaatttcgtaatgatccagcttatttttagtggtggcttgccaactcaggttgacaccggcgtacttgccttcttcgtcgaaggtccgattatcaatggtgacctggttgacctttttcggcgcggcctgctgcttgccggtaattgcgaggcgacctaattgaacgctgtagctagcatcagtctcggcggcactgattttgaggctaaggcctttgattgtttttttgttaactgactaacgtcatagctaacggtcgtccagtgcttgctgagtgtccggtcacccgcgatggtcttagtgcggccgtcctttaaggtcaccactagtttagctgtagatttaccagatgccttagcggttaaactaacctgggtatcggcagtgacgtctaggtccgtggtgtagagtttgattgtgctagcggtgtccttacgcattttgccggctaacttgatatcattgccaccttcgtaggcgtcagtgtagtcaaagctggcctttaacgcattaccattgccattattgattaaccagcggtaagtcggattgactgcttgcagtgagcgattgttccaatcacgtagcgaaacatttttccccttaatgaagtagttatagccattgcctaagctgaaattagtgacaaagggctgtttcgtaatggcactttgttcaaccgcgtatgttgaaacacccggccaatgtgttgaagtagttgacggaatgctacgggacggatcattttgatcattgacccacagagcaccttctttggcttgaaattcgtcaaccgtatcggaagaagcgtgtgtccagtccggtgcgtacaatcctagcgacgtgtatggcacatgttgtttattagcgaatagattccaacgaacaggggtagcggttccgtcagcttgaacatcgattcctgcaaagaggttgtaaggactaatcccaagcttttcggcgcgttcgtgtgactttttgagtaattcttgactggcgagacgcttcttcgtccaccagaagttaagaaacatcgagtcagcaactggtttcatattggcatcgactagataagattggttttctttggtcaatgcgttttgccaatccattttaccatccttcgtcatcgagtcataccacatcaggtctagcttggagccggccttttgtttgtattctttgattaactgttgcattagttgggcgtgctttttgctcagcccattactagttgagctggttgcggtctttccggtggaagccgaatcaaaacttttaacttcggggtcggtctcttggttgatgaaccagccgtcaaacccgtaagctttcgcaaccgcgactagtttatcagccatcggaaaatgtccgtcagcatcttgttttaagaagtcattgagccactttaacttcccgccactaaccacttgtggaaagaaaacggttccaagaacgggcacgccgtttttatgagcagaatcgatgacatctgcggtcggtggcacaatcaaaccttcgcctgccgaaccgccccagtagacgagttggtcaatatactgccagttggagaagacattcacatcgaacgtattaatcccgcgaggcgcgttgccactagttgaactattcataatggataacgcgacgaccttcatctttgggtcctgggtcttgttaaccgtcggcagttgccatttatcgatccgtttggctagtggaaccgaggcggtgttgtacttggctgctttatccttgctcaactgccatttcagcagttgttttggaaaccagtacggtgcttcgggttgattatccatccccttatcaagggtggcctcagccgtttgacggtaactgatctgctgattagctgactgtttcgaacaagctactaaacctacagcagtcgttatcaaagctagtgtgccaacaatgtagcgatattgtccatgtctcatagcgatatcctcctgtgaactaagcaaaattgacatatccgcgttatgtgagcgctgattgcatgaatcgtaattaaaacgtggcctcgacttagatttttgaccaccgcgctctggcaattggcagaaatgcctggaggtcggtgtagggtgaactaagcatatttacgctaacctgaactctttccagcgagcctaagccgactgcttttgacgttaattattttgcctactttaatcatgactcatgacaaattagctagcacaacgcgtgaaatacaaatctctatatattgctggtatgtatgatatcggtttcggtgacagatgagtatagctaaattaagggaattcttccacaaattaaactaattgatagggtcaatcaattttgatgtaaggagaatgctgggtttcaacttgcgcgcaatgtgtgaataattgaggattgttgcggtgccgatacaatttaacgaacgcgaatttttgcgtgatgaatggtatgtagtataataactagctaggaaggtgattatttattaagtataaagttgataatggtgaatatcccagtggtaaggacgctgtggatcccaagcgagttaaatatctgaaattgattagtaagttagcgacatttacgtgtattgcgatgtacgtgtcatatattccgcaaatcatttcgaatttctcaggtgacccagtatcgccgctacaaccactcgtggcaatgattaatgggatactatggactggttacggctggttcaagacttataaggattggcccgttattatttcaaatgttcccggggtgatttttggatttatcactgttttaaccgtatatattcattaaccgaatgacaaattgactgtaaactaaaagtccgctgatacgtttaaacgcgtatcggcggacttttttgcaaggtgttaagcgttctttaaagcagcctgagctaacaataggccaccggcaatgccagaattgttacccagtccagcgggaacgatatagtcatccagtggtgggacttcttcgtagccatttagataggcggcaaacttttcacgaatcatgggaaagagctgccgttgattcataacaccaccgttaagaataattttatcaggtgcgaaggcgacggtgaggttgacacatgcctgtgcgatgtagtcagcgatgattggccagaccggatcgtcgacgggaatatctttcccagctttccccgttcgttttcccactgctggcccagcagctaaaccttctaaacagatgtcatggtaggggcagttggacttgaaatcgtccccaggtaaccggttgagtcgcatgtgaccaagttcagtatgagtgcgaccattaaaaatgtggttctgactaatgacgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaaatcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttaaaaatgtagtcttatttattaatagtatactcttaattagaaattttgttaacgattacattaactttgacgtaaatgttgcgtgctaggcctgattaaacctgtcagatcgttttatatcgctgtagcagcaactgagctagctgtcggttcagtcaacgcaacgagctgttcaccagcttggacatttgtgactttgagtcgttcaacattagcgtagttggccgtatttgtgacgactagcatgacggttggatcatagttagcggcttttaaggcagcgacgtcaaacgttccgagtagatcaccttgatgaacggtatcgcccttttgaacgttagtagtgaagtgttcaccatttaaattgaccgtatctaatcctaagtgaatcagaatttcggcaccagcagttgttttgatgccataagcatgatggctatcataagtgacagtgatgaccccgtcagctggtgcgacgacctgatcagcgcttggcacgattgcggcgcctttacccatgatttcggctgagaaaacttggtcgttaacttgtttgagactttcgctagtccccgttactggtgcactgataatctcatcattaacattgatgacggtactcgttggtgctggtgattttacttgatcacgatcgtcaccgagtgttcgtttggcatagataaaagttggaataaatgcgacgacgaacgagatgacagcactgagcatgaatgctggaatcgactttgaagcaatcgaaatgaacccgatgactgatgcgggacccatcgccacggacagaacgtggaatagtcctaagaaagctgaagcaattcctgaggcaatcgctgcaaagacaaatggaaatttcatcttgaggttgaccccgaaaatagcaggttccgtaattccgagtaacgctgagaccccggctgaagaagtcagggctttttgcttttggctcttagtggcaaagaaaatagctaaagtggcggcaccttgcccaatgttggccatcgaggcgactgggaagataaaagaacctcccgttttggcgacgttagccaataactgggtttcaatagccgggaaggtttggtggagcccagtaatgacaatggccgagtagagaaggccaaagatgcccatgccaatccaaccagtcgtgttatataagcctactaaaccgttagttaatgcgtcgctcaccgttcgtaagacaggaccgacgattgtgaaagttagaaagccagtgatgacaattgcaaacattggcgtgaacgtaaagtcaaatgcacccttgatatgtttgtggaagaacttctccaaagtagccaaaatataagcaacggccaaaacagggagcacttggccttgatagcctgcttgtgcaacgtgtaaaccaaagacgttccagtaaaccatcttgccagcagccatggtcgttgcaacgctatagccgttaactagtgatggtaagaccatgatcatgcccatcgtagcacccagataggggttgccaccgaagcgcttcgttgctgaaaatcctaagaggattggcaagaaagtaaacggcgcactagccatcgcgttaatcatttcggcgatacctttgaggccagggtaaacttcaacaactgacttcgccataaaaagatgctcggcagtcaaaacgttgtttagtgccattaatagacccccagcaactagtgcagggacgattggaataaaaatatcagataagactttgaggaagtccattaatggatttttcttttgacccgcagcggcaactgccttgatgtcatcgggggtcgcttctttaagacctgttttggcgattaaggcgtcatagactttatcgacatcgccagggccaataatgatttggtattggccgttagtttcgaaggtccccttaacgtccgcgtcgtcatctaaggcttgttgatcaatcttggattcatccttgatgaccaaacgaaggcgtgtcgcacagtgggcggcggcttgaatgttgtttttaccaattgcattaagtacgcggtcggcaacttcttgatgattcataataattcactccctgagtctaaaattatttttaatttaataatgcaagcgctttacagacccaataataacaagtttggaaaatatgtcaagcgtttgatacaaaattgaattgcttgataatcttgttaaaaagccgaatttgaaacgctgacatgaaaatataatataaaaatgtcaaacgattgacatatcagtgtaagcggttttataatagtgacaattaagtcgaacgttaaaaaggagctcatcgtcatgatatggaatcgtaaaacccgttataccccttatgaacagtggccagcaactaagctaccacagctcgttgcccaggcacgccagtctaagtggcggatgcaacatcatattcagcctacatcaggtttgttaaatgaccccaatggcttttcatactttgatggtcagtggcacctgttctaccaagtctttccgttcggtccggtacacggactgaagtcatggcaacacgtgacctctaagaacttggtggattggcatgatgagggcttagcgattcgaccagatacgccgtacgactcacacggcgcgtacacgggtacagcactaccaattgatgatcagttatttattatgtatacgggtaatgtccgtactgccgactggcaacgtgaatcgtatcaattaggtgcctggatggacacggataatcacattaaaaagctgtcccggccactaattgcgcatgctccggctgggtatacgagttcgtttcgtgatccggacttgatccggactgaccacggctactacgcgctaatcggtgcgcagacgactactgagatcggtgctatcttggtttatttctcaaaggatctgaccacctggacgtgtcaaggcgagttgaacgttcccgcaaatgcgcggggttatatgattgagtgtccaaatctggtctggatcgatcaacagcccgtcttattgttctgtccccaagggttatcacaaacaacgaccccgtatcagaatatttatccgaacatgtacctagttgccgatcaattggatctggctcaggcacaattcactgaaccccacgccctgacgcaattggatgacggctttgacgtgtatgccacgcaggcaatcaatgcgccggatggccgcgcgttagccgtcagctggattgggttacctgaaatttcctatccaactgatcgtgaaaattgggcccattgtttgagcttagttaaggaactaacgcttaaagatgggcacctctatcaaaatccagtggcagcggtggatgatttgcggacgacggcgcatgacctagtctttgagcaacaacgggcgacggtggccgctttgaatggcagctttgaactcttactgacggttcccgctgataaaacggtcacggttaacattgctgatcagcaggaaagtggccagctgcaggtgactgttgatgccaaccatggtcaggttatgattgatcggcggcatacggggaattcgtttgctgaagattatggtcagactcgtcaagttgagttaacggcccataagacgataaaaatccggctaatcatagatgtgtcagtctttgaatgctatattgataatggctattccgtgatgaccggccgtttcttcttaaacgctaccccgagtcgccttaacgttcaaggtgacactacggcagttaccggtaaagtctgggaatggcgccaatcagagcatactggagtcgataacaatgaaaccaaaattaaatgatgttgcgaagctagcgggggtctcagcgacaaccgtttctcgggttattaataaccatggctacctgagtagtcagactaaagaaaaagttttcgcggcgatgcgagaactgcattatcagccgaataatatggcacgctcactgcaaggaaagaatacgcgcttaattggcgtcatcttttcagatattagtaatccgttctttggtgaactggtgtcccggattgaaaaaatcttatttgctaaaaattataaggtgattttatgtaatagtgcggatgatccgcaaaaagaacgcgactacctacaaatgttgatggctaatcaggtcgatgggattattgctggtgcccacaatttaggtattgaagaatatcaacaatacggtcttccgattatttcatttgaccggtacttatccgacaatattcccatcgttagttcggataattaccaggggggctggctagcaacccagacattgcatcaggcgggggcgactaacgtggctatttttactggtaagtcacacgctggttcgccaacgaatggtcgccgtgaaggatatgaagcctacttgactgcccaacagctaacaccccatgtccatgaattaccgtttgaattgacccccgcgctgaagatgatggaaattaagacgattatgacacaacatcagtatgatggtattttttgtagtgatgatttgaccgctttactagtgctcaacgtcgcgcgacaactgtcattaacggttcctgagcaattacgcgttgttggttatgatggcacggcgctcatacgtgattatcattctgaattaacaacagtagaacaaccgttagcggatattagcacgttactggtttctctactattgcagcggattgaggatgcgaattgtacactggaatcaaaatatacgttaccagttaagctcatcaagggccttaccgcgtaactaaggagttaatcgtaattatggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaattattgcaagccgcccatgaccggggcttaaagatcatcatggacttggttgttaaccatacctctgatgagcatccatggttcaaacgcagtcgccaggaccgcaccaatcaatatcgtgatttctacttttggcgctcaggtaacggcaaaaaggcgcccaataattgggatgcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccgggttaccagatggtccactgaaaccgcacagtcagtttggcgatgctcgagtaacgaacggaccgcgagttcatgaattcttgcaagaaatgaaccaagaagtgttgtcacagtttgatatcatgacggttggtgagacccacggggtgacaccagcggatgcgctgaagtatgcgggcgctgatcggcacgaattagatatggtctttgaatttcaacatctgcgacttgataatagtcagcatggtcttggtaagtggagtacgcgtaagacaccgttagtggcgctaaagaaagtcattagtgactggcaagtcggacttgaagggcgggcttggaacagcctgttttggaacaatcatgatacgccacgagcggtctcacgttttggtgatgaccgaccagcatatcgggtacgttcggctaaaatgctcgcaacgtgtttacacatcttgcagggaaccccgtatatttatcaaggtgaagaactggggatgactgacgctcattttactgaattaaccagttaccgggatattgaatcgctcaatgcctatcgtgatttagtgactgagcgccaactactatcaccggcagatatgatggcccgattagcggcgcgttctcgggacaactcgcgaacgccgatgcaatgggacacggaggttaacgcgggttttagtgacgcggcgccatggctcacggtcaatcccaactatcgtcaaatcaatgctgccgcagctttggctgatccggattcagtgtggtactattaccagcacttgattcaattacgacatcaataccccttagtgacgttaggttcgtttgagctcttgtgggctgatgatccgcaggtattcttatatgcacggcaatgggaagggcgaacctggctagtttgttgcaatttcacagccgagacactgtcccgaccactggatcaatatctgacgcccacggccaaatgcttgattagtaattatggcgagcagcagccaaataaattacggccttatgaggcttgggtctaccaactcgcataggtatccaggacttggctaattgaggcggtctttgaaatatacccaatcgttacgattagtgtgaattgggttgcttaaaattctgcgatggtcttaataagcgaccacctgactaaaaaactgctttcaaaaggataacttttgaaagcagtttttttagcgcgcgacgaccacttgacccacgtgaggctcatctagtcgttggtgaccttgaatgaagcccgtgaggttaaacggtagttgttcattgatcgtcgtggtcaattgaccagtatctagcaacttgaatagcaattgtaaggcggcctgatcagaaatcacttcggtcggttggattgcttggaaacgaattgatttactggtggctggcaagtgacgggcaaacgaagcgatggtcgcatcaaatttggccattgctaagtcatctttgccaccaacgccatcgatagcgacattgattacgacgtcaccgcggtcggctaacacgtgaactggattttgatgctgatagtcgacgaattggtcgactcccagtgtcgcaatcaagttagcataacggtcactagcaatcgcgataacgtgggcacctaatcgtttggctaactgaataattaacaagccgactgggctgccagcgcctttgacaatcaccgtttggtcggcttggatgtccgcaaagtagcgcaccgttttgtaagcgacaatccctggagtgactaagctgacggcggtgaccggatcaagattagttggcatggtcaccgctagatcgctatctaaacaaacctggtccgcgtaagtatggttcgtgcgggcagccaccactgtcccaacgtccaagtcagtgacagcggcgccaacttgaatgattttcccaatgacatcatgcccaggaatatgcggtagtgcgacgctttggatagtacctagccgttctaagcggtcttcctcggttaggttaacggctaaagttttgattaataattgattatctgttggaatcagctgtgattgtggtagttcttcaaatacggtaggtcccccaaatttttgatacccgtatgcaagcattgtaatccccctcctcatatctaagttcgttagttgacgtggtgccgggatgtgacttattagtaaataaatcatgcagtatcaattgacgaattgttagattgatccaaaacatgctcttgtctaattgtagccagcagtgggggcgaatcacaagcagtaacaattatattccgggattggttcggtcaccgattaaattaaacaacctagttttaaattaaccggcttcgttggctggctgatgcttcaggccccagccagtgaaaccactgataattgagaataccggtgatagtaagctgaagaaacaaaatggcaggtaagctaaggttgataccccgagcgtgttagcggcaaaggccccggcaacgccccacggaatcaggtaattgatgacagttccaccgtcttcaaggactcgactgagggctaagttagccaatcctcgctgattgaaggtcgttttgaacgctttaccaggcaagataacggaaaggtactgttcacctacaaagatgttgacaccgattcccgctaaaatcgcagccgtaacagttgccccggcacctttcaatcgcttagttagcggcaccattgctgtctgaatgaggttgaatttcattagtaaaccgcctaacgacagggttaataggattaaggagaccgtgctcatcatggcactgataccgccacgtgagagtaaggcgtccaccccggcgttgccagttttggctacaaagccggtttcgatcatcgtggcgatcttagttaaggcaatatgaggttgctcgataaaaatcatgacgatggcaagaccgatattcatcaacaaggttgcaatggctggaattttaagtagggcacaggcaaacatgacgacgagtggcaaggccgcccaccagctgatggtaaagttattattgaggacggtcaacgtcgtttgaatcttgcccaaatggctttgtgttgcggctccggcacctaaaacggcgtagagtactagtgatacgacaaaagcaggaatcgtagaccacatcagattacgaatgtggtcgaataaatctgcttcggcaatggctgcggccaggttggtcgaatctgacaacggtgaagtcttatctccaaaaatggctcctgagatgatagctccggcaatcaaagctgggttgatgcccatcgttgtcccgattccaaagagggcaatcccaatcgttgagataatcgtgaaggcactcccgatggaagttccaataattgcacaaacgagaaaaacggatggaacgaaccactgcgcagagatcagatgaaacccaaagaccatcattgaaggaatgatgccagctgcaatccaaacgctgatgagtgccccgatgagtagaaaaataaaaattgggataatcccagttttaataccatcgatgatgccaccatgaatgtcatcccagtgggcaccgcgaattcgggcccataaaatgatgagggcgataacgagaataacgggggtctgtggtgacaggccgaacttaataacgccaagtcccataattgcaagcataatgagtaaaacgagtagggcttctggtaactgaactgaacgccatttttttgaattaggcataataattaactcctttgaggtcgttaaaccagcagtgaatagcccgacacggactgcttcaacaacggttgtacgccgataatagtgggtgaatataaaaaatcgtccctgttgcattattatgcaacagggacgattgattagaccgtggtaccacccagcttgagccacaatatgactccactcactagcagttaacggctctagttgttatccgccgggcgtacccggacctctcctaccgtatttcatcgagattaacctgatcggttcgcagcacccaccgacttcctgacgcacagttaattcgctacttgaaagtaagattatcgttcgttatttgaatataagcgataatagcatggcgtttttgattcgtcaactaagatatggctagaaacgtgttaggctaacaaataaatagcgataagtgggtacgctcaaatgaccgacaatggtagaatggttagtgttgtaagcggtaccttttatggttgaccgtgacaagttttttaaagcaaacttttttagggggataatcatatatggctaatcaatggtggcaatcagcggttgtttatcaggtttatccacggtcgtttcaggattcaaatggtgatggaatcggtgatttgccaggaattacacaacggttagattatattaaacagctcggcgcggatgtgatttggctcaacccaatttaccgttcacccggtgtcgataatggctatgatattagtgattattacgatattaatccagaattcgggacgatggctgattttgatcaattattaacaacggcccatgcgaaagggttaaaaatcatgatggacattgttgtcaaccattcatctgatcaaaataagtggtttacgacgagtgcgcaaagtaaggataatccgtacgcggactattatatttggcgtgatcctgttgatgggcatgaacctaacaactggggtggctttttcggtggctctgcttggaaatatgttgccagccgtgatcagtattacttacattcatttgcggttgaacagccagatttgaactgggataatccgcaactacggcaagcagtctatgacatgatgaatttctgggtcaataagggcgtggacggtttccgcttggatgtcattaacttgatttccaagcctgatagctttgcagacgggcagccagaagctggggaaccatacgcggcaatcggtggaattattgccaatggtccgcatctccatgaatacttacaagaaatgaatcagcaagtgtttgcaggccatcaactgatgacggtcggcgaaacgcctggggctacggttgctgatgctaagcaactggcaagcggccaaggtcaggaattaaacatggtgtttgaatttgaacacatgggcctggatggtaatccagatccggcgctaggtaagtggaatgaccagcccgtccgactggttgacctaaagcagagcttgtctaagtggcaaatgggcttacaagggacagcctggaatagtctctattggaataatcatgaccaaccgcgaattgtgtcacgattcggggatgaacggccagcttatcgggaacgttcagccaaaatgctagcgaccctattgcactttcttcaagggacaccctacatctacgaaggtgaggagctaggcatgacgaatgcccattttaccaagttaaccgactatcaagacttggaatcactgaatgcgtatcatcactttgttgatgacgaacaggtcgttcaacctgaacagatgttaggttatctcgcccatatgtcgcgggataatgcgcgtacaccgatgcagtgggatgatagtcagaatgctgggttttcaacggcaacaccgtggctagcggttaatgccaattatccgcggatcaacgcgcaactcgcgcaacgaacgcccggttcagttctgagctattatcagcggctgattaagctccggcaccatttaccagtcataacgacgggaacttatcacctattatcacctgatgatgcggccgtttatgcctatgtgcggcatatggggtcgcagcacctgctagtaatttgtaactttactgcggcaacccagacgcgacactttgcagaattacccgctgatgcgcatctgttgatcagtaactacgatgaagatcatcaagacgtattacgagcgtacgaagcgaaagtttaccagttttaggtcacaattagcttcgctgctggagtcgtgaatgtgatttttaacggcggttgtgtgattacgagcacgagttggtcgtgtaaatttaatcgtgatgacttaaccaaaaatgcgccccaataagaacgcccaacctatcattctagataagttgggtatttttattggagcgcatgtatgattatgatcaagtttgtggttaagatttttgttcggcattgtcagccgcaaatgttttttcaataatgtcgataacttgtttgaccaagccaattggaaattggtgggcccgacgaatcaagttgatatgcacgctaggaacctgaacgtcgtcgaacggaatctcaacgagaccatcgtcttcaccatcgttgggggtcgtgatgtcggaaatgaagcctagtgccaggttctctttaactaatcccttgatcaaggtgctgctatcagattcgaagagaacttggggttcaatcgaaagttgttcagcaagttgccggaagactagtttatttaagtaagttgcattaagcagtacaaaaggcgattttagcgcttctgcaaaagtcgggtgctcagcctttgctaaggggtgcgcaacattagcgagaatgcgaaatttaaaaggccgtaatggcgttactgctagccgttcatccaatgtttgatccaagttaccactgatggctaagtcgagttggccggctaaaacctgtttgacgagttgattagcccccatttcaaccgtgtggacgctactaagcaaatcttgctcgatgattggttttgttaatgccggtaaataatgttcactgacggatggttcgataccaaaccgcagtgtatgttgacgcaaatgactgattgattcattgacatgctgccagttgttgataatgtcgttggctgcgagcaatagttgctggccactaggtgttaacaccagcgccttggtctttgcttggcgaaagaacagtgtcacttgaaaatgacgttctagtcgtttaattgcttgggagattgtgggttggctaacgtgaaaatcagcagccgtttgcgtataactctgagtgctgattaagcgttggaagtaatacaagtctttaatgttcatgaaaaatgtagcctccataaaatattaatgttggttgcgcaattaatagtcgcaggtaagcaggctccgactgattgattaaagctggttattatacgtcatgttaatcataccattgttataacgaatagtgtcaggataattagtgaaaattaatttacaaaatagttaacgcgcttaaactataatgattattaataagaatgttagtgctgattggtacagatgtagtgttgctggtaaattaagttttgagtcattatataattttatcagttaaagggctgccacatcgttttgattatcatgacgtgtcggttggtctgattaatcaccggaaaaaaaagttgcattgcttaagtgggagtcgttagaaataaaggttaaagtgttaaagcgataagtaaacattatgcagattaaaaagcatacaagttaatgacaaactattagtaataaagctataaaaaatacttatcagttaaggtgctgttatatatcgctcgataaatcaataattggtctacgtgtcatcggtagcgccagtctgccccgtttctcgacgtaattagttgacaagcaactaaagcagttaatgggtttaaattataaatgaaacgaatgacatcatttttactgattgcaattagttaaatctatattaatcagcataaattattttaattagctaacaactgtcacgaactcgtcaaaattgatggcatacaacttttgtataaaatattataatactaattatgattcatgtctttaaaatgttgatatatcggtaaattaattaagtgtacataaataaaaattatataggtgtaatgagccttttgaacaaatattgctggtatgtaactgctatctgtgagcgacgaattttgacaaaaagtgtcttcaaatttgcggaatgtggtttataattaaggcgtgtaatcggtttaaaagttttaacttatataagaaaggggggatatcatgcgattaatcgatttcaaaacttggataatgggaacggccgccatgttgacattgattgtgacaaatcaaacagtgagtgcggcggacacagctaccactgccactgaaacgacgcagacttctggctcgagtacacttgctaatcaagtggtgttgcgacaaactactagcagtagcagtagcagtagcagtagcagtagcagtagcagtagcagtagcagtagcagtagcagtagcagtagcacgaaagcatcggcaactggtgcggcgactgaaacggcgactagcaaagcggtcaccacgtctgagtcatcaacccaatcatctagcacaacggctactagccaaacgacttcaggtgtgacagccgctcaagcaacaacggacagtactgatacgacagcgatgtcccgggcgacggctaatgccaaagcggatcaacgagcggctagtgcgaaggcgaacaacgagcaagcaacgacccagaatcagcaacaaacgactaatatgtacagtggtgttgttaccagtcaaaaagactcggcgagaacggcaactacgacggatcaagcaactgcgtctgtcgcgacactgtccagaatgagccgggccagtcttcgcagtttagcacaacgggcaacggttgcggttcaggggctcgatgctactgacgcaacggtgactgacgatgatggtgttacgtatagcgctacggatgtattgagtctgtatgcgaactatatcgcgaagtatcattggtcaatagccgatgatgttagcgtaactgctggcagtacagcaacggtgaccttacccgagaatgttgtctttaccaatggtacgcagcatattgatgtccaaaaatcagatgaaacggtcgtcgggacttttacggccgagaccggtagtcaaaccggaacactaacttttaatgattattatgcgactagtgatcgttataatcgtcaaggagacttaacgttttatgttactgggactagcgcaaccactggcagtagtacgactgggattaataaggttggctgggccgatagtaatagtttagatgctgatggtaatcccaccaaaatgatctggcaagttgtcgcaaacattaatagtgaaaagtggcagcaagttgcgattgttgatcagctgggcctttatcaaacgcacgaaggtaccatgacgttggaaactggtcattatactgacggtgcctttgttaaagacgcggcactgggcacttatgattttgcaacgcagcagtttacctacgctgatggggtatcaacaccacaagtaaccgtgacggttgtgggtcagcagatgacaattaatattgaccaattagatgtagcggtcaatatattttatgaagttggtctgacagtaggacatacgtacaccaataatgcgggtgtaacgtatgcacctgtcattggagatgcgactgatccaaatgagggcagttcgacaggcgaaccaaagagtgaacaatcgaacgtggccgttagatttggtggttccggaaccgctagtgatgacattcagagttacagtttgttcattaataaaactgatggtgacggccagtcagttgctggtgccacttatcagttagaggatagtacgggtacggtacttcggaccgatttggtgactgattcagttggacagttacgcatcggtaacttgtcggctgggacgtacatgctgggtgagacggcggctccgagtggctaccaaatcgacacggccaagcacgtcttcgcggtatccgcagcgcaagcaacggctaacgtggtcacaggtagtgtggttgacaaacgaattgctaagacggcgctgactgttaacaaagtttgggctgacgtgccagctggagtgcaaacgtcgaccgttgaagtgacgttgcaacgcaatggtcaagcttatcagaccttgcaattaacgtcagcaaatggctatacgggcactttcagtgatttggatgtgacggatgtttatggcaatgcgtacacttatacggtgattgaaacggccattgctggctatatcagtagtcaaacaactagtggtgagacggtgacattaacgaatacgtatcaaaccgggaaattgacggtgattaagacggattcgagtggcgccaatcgcttggccggggcggtttttgccgtgaaaaatgctgccggaacgctggttgctcagttgacaactgatgcgactggtcaagcacagcttacaggtctaacgcaaggcgcttatacggttagcgaaattcaagcaccggacggttacttgatcaatacacaggcgcaagtgcttgtgttgaatgagcaaagcgcttatcaaggccaattagtttttgccgatgaggtcgaaccaagtgaaccgagcgaaccaagcgaaccgagtgaaccaagtgagccgagcgaaccgagcgaaccaagtgaaccgagtgaaccaagtgaaccaagcgaaccaagcgaaccgagcgaaccgagcgaaccaagcgaaccgagtgaaccaagtgaaccaagtgagccgagcgaaccaagtgaaccgagtgaaccgagtgaaccgagtgaaccgagtgaaccgagtgaaccaagtgaaccaactgaaccaagcgaaccaagtgagccgagcgaaccgagcgaaccaagtgaaccgagtgaaccaagtgaaccggtgctaccaggacacgctgacgaggatagtgattcagatcaggttgtcacaacgaagactgagacagctaagttagtcaagcaaactaatttagtaaccacgactcggccaacgaaattgttaggacagccaataaaattagtagcaacttctaaaccagttgttaaagttacaaaagcaactaatcgcaagtcggcgcaacaattgccacagactagtgaacaatcaatggattggctaatgattttgggctggttcttgctagggctaacagttgttagtcgtcaacggcgatttaattaaacaaaaaggctactggaatttcgcttccagtagcctttatttatatcatagataagtgtcgccacattatcgacgattttgagatgtgcgttggtcatgcttaattctgactggttgggcagcgggaacacgggcgccagccacgacgccggcaacggcagctagtccggctgcggccaataaacctgctaataacatgggcaagacctcctcaatagttgtaaaaactcgtcttttaatacttgcagtttaggcgacttattaacaaaaatcaattatttaaccgtaaattagtgagaatctgaataacttgaaatattcttaagtaattgccggttattgttcattctggcaagggcggccgcatcatttaaatattcatgaatttgatccggttcatcggataattgagcctgtaagaatttgatccgcgctgcgtaataggtaacgtggaatcgcgcacaaatctcaatcccgtagtttaataactgcaaactccgcggtgtatcattaatgttagcgtaaaaagcccccgtgtaataagctaagttaatcacgcgccaaacactagcggtcgtttctagcggtaggttcggtagggcgtggcgtactttttcaaaatagtactgggctttatcgttatcctggttctgctgataagcaatcccgataccacagtaggccagctgtgtatagattgtgatgtgagcctcgtccaaatcggtgatgatttggtcaaaattaaagatgacatcactgatcgggtggtggttaagggcagcaacatagccttttagataacaatattgtaatttggtttcgcggtcatgtcgcggcatatccgcagccttttcaagttgtacttcggcatcttgatattcagttgtaatgaggtcgaactcgacctgttccaaaatcttcaaaacagcggcatcagcgacgcgttcggttggaaagacatcttccaattgtaggttgagtcgctgacaaagttgggcaacgattcgtatggcaggtgctttgccattgttctcgaacttacttagtgtcgcctgagtacaaataccatctgctagggccttttgtgaaagtcctagggctttgcggcgggcgatgaaaagctcaatgttcataccatcaacgcttcctttacatatttaagtcataattgaaacagctttcatttaccctaattaaaaactttttatataattttgtcaatatttaaacataatcgtgcatattctaaaaatatatcttgactatataaaaaacgctcgctagtctttgctagtgagcgtctgtgagttagctgatggtttattttgccatataggcgtctttgaagttatagttggtaccagaagtgttataaatcaggccctttaacttagggttgaccatctgtgccagcgttgtttgagttaatggtgcaacgccttcatccgtcccaataattttttcagctttgcctagagcagtccagcgtactgtcggatcagttgcttgctcggcctgcttgacagcagcgtcataatcagcatttttccacttaccaaagttgtaatcattcgtggaagtgagaatgcctaggtcagagatggggtcggcgaagtcagcttgccagccagaaatagcgagttggaaattacccgatgtttcacgtgcaagtcggtttttgaatggcaaggtaatatcggtaatcttcaaaccgggtagttccttttctagctgtccctgaacatattcggccgtctctttggtttggtcaatattatcgtgcgtaagcgttaaggttaatgactttttgccggtttcttttaatccttctgcccacagtttcttggccttagcggtgtcttgagttgtcgccgcactaactgcattttcagtagcgaaatcttcaccagtcgttggatcggttgcgagcccggtggtgacaaagccctttggaactgctgagccatccgctagtacgtccgtgacaagttggtgccggtcaatagttaaggacatcgcttgccggagcttggcattagctagcgcgggcacctttttctgattaaactcgaggtagttcagacgggatgtcttacggagcactaacttgggattattcttttcgtttttgacttgttcgccgctcagggtggccatgtcgagtttgttgctctggaataagttgaatccggtcgtggttgacttaacgacttggtcattgatcttttctaagtaaacgtgttttttatcccaatatttaggattgcggttcagggaccatgtcgtattagtgcctttccagcccttcatggtaaacggcccatcgtagaccatcttggtggccgttgtcccatagtccttgccgtatttctgtacggcgtgttggttctgcgggaagaagatggcaaagcccattaggagtttaaaataagccatgggtttatcaagtgtcacggttagcttgtatttaccgtcagctttaattcctaaactattggctttagctttaccattggtgatttggtcggcattcttgataccagaataaagataagcatattgcgaagcggtcttgggatcgatggttcgccgccaactataaacgaaatcttgagcggttacgggatcgccgttgctccacttggcgtctttgcgcaatgtgaacgtataagtttttttatctttggaaatgacagtatgggtcgcaatgcccggtgtgattttattattattgccaatacggtagaggccctccatcgtgttattgatcatattggcactgatcgaatcggtgactagcgaagtatccaaagtcgttagttcggagccattttctgaccagttcaagacttgcttttgtgccattcccgcgcgtaagttccccgcattatctgacttggactgaccttgactacaggcagctaacaaaaggccggtcgatgcggccgcagtagcagttgtcaacattactttccatttcatagtaaaacttccccccaacttgaatggtcacgagaatacattaaagcaagattaaaatcaatgctttgattctaataattaaagtaattaacagccgcaaaatgtgtcaaggaacacaaaaaaagtaccgtagtttgttgctacgataccttttattgtgcgatttaagggtagtttgacgtgaggcgatgctagttaggtcaccttatttggccatataggcactcttgaagttatagttaatgcccgccgtgttgtagactaggcctttcagcttagggttgaccatttgtgcgatgacgttttgtgagagcggtgcgaccccttgatccgtcgccatcgtcttttcagcggttgcgagagcttgccaacgcttcgttgtactggttgtactatttgctgtgttgatagcactatcgaaagtcttgttggtccacttaccaaagttgtaatcgttagttgatgtcatgataccgaggtctgaaactggatcagcaaagtcggcttgccatgcggagatgaccagctggaaattacccgcaatttctcgggaaattctcgtcttataaggaacggtgacactttgcactttaagtcccggtaactccttttccaattgtccctgaacatattcagcgagggccttcatctgatctgtatcgtcatgagttaacgttaaggtaaccgacttcttgccggtttcttttagtccttgtttccagagctttttagctttggtggtgtcctgagtaacagctgatttaaccgtattttcggtggcaaagtccttaccagtcgttggatcagtagcaagtccggtcgtaacaaagccctttggagtgacggaaccatcgccgaggacatcgttgaccaactgcttacgattcaaagtcagtgacattgcttgacgaatcttcttattggcgagtaactgcaccttcttttgattgaattccaagtaatttagacgtgaagacttacggatgaccagtttgttattattcttttcgttcttgacttgttgtccagataacgttgccatgtcgagcttattactctggaagaggttaaaggctgtcgtcgtcgacttcacgacttggtctttgatcttagttaagtaaacgtgttttttatcccagtaattaggattgcgcttaagtgtccaggttgagttggtccctttccaaccagtcatcttgaatggcccgttgtaaaccatcttgctggaactggtcccgtagtcctttccgtatttttccaccgcgtgctggttttgcgggaagaagaccacgaaacccatcaataatttgaaatactgcatgggcttttcaagtttgacggtcagcttatacttaccatcggccttgatgcccaaggtactagtcttggctttgccgctgacgattttgtcagcatttttgataccggaatataagtaggcgtattgggaagccgtcttcggattaactgtacgacgccagccatacacaaagtcttgtgcggtcacttgatcgccattactccatttggcatttttacgcagggtaaaagtataagtctttttatctttggacacggtcgttttagtggcaatacctggtgtgaccttactgtttttacctaatcgatacaaaccttcttgcgaattactgatcatcgtcccactgataacatcagtggctaaggacgggtcaagggtggtcaaatcctggccgttttccgaccaattgaggacttgagtcttggccattttggccgttgtgttgccggcattgcttgaactggatgaggactgaccacagccgacgagtaaaacgccggtcgttgccgttaacgtggcaactgtggcaaataatttccattgcatatatgtaccccctgcttcaaatgattatgatatgtagatgagaatacattaaaattagattaaatacaatattatttttttaatcattaatattattaagcaaataaagccagtacgactcgttaagaatcgtactggcttaattaagaaaactaacgttgccattgcatcgtatattctggttgctgggttgcttggtcactagcctgatcaatgacacggaaaccgtgatagtgataaaaggcaatggctgggcgattagcaacatagacgtttaattgtaattgatgatggtcagcttgggcagtcgccaatagcgccgtccccagaccttgatgttgagcatcattgcaaatgaaaattccggcaatgtaatcgttttgtaagcctataaagcccagaatataagcttcaggtccgtcggtcagtccgacgatgagttcggctgattgtaatgcttcacgtactaagggggcttgttgacgccagtagtcggcactgacaaagtcatgggccgttaaattaccacttaaccagattgtcattaactgatcgagttggtgagttgtcgggtgttgtaagtgttcaatcttcattcgacgctaccccgttttaatagtcgaacgcgactcactgccggaattttagacagttcagctattaggtcggcttgttgtggctgctgtaggtcgtcgacgtcaatgatggtgtaagcaatctggtgcttagcggcgttagccatggtagtgatgttgaggttggccgctgctagtttggccgtgatttgactcaccatgttaggcacattttcgtgaatgactgtaaagcggtaagccgcgttgaacgggacgtttaagtctggcagattgatggctgcatgaacgttaccggtttccaaataagtcatgatagtgcgcgcagcttgtgtggcaccgttgatttcagcctcgatagtcgagccgccaatatggggtgtcacggtaaccgcggattggttggcaagctggggttcgccaaaatcggtgtagtagtgggcaacttgtcccgtggctaacgcattcatgacggcagtattgtcaacgatgcccagccgtgaataattaaataattgaacgcctgttggcatggcggctaacgcatctttattaatcagatgaagtgtgtcggcatttttaggaacgtggacggtgacaaaatcagcttgtttgactgcatctggcagcgtggccgctcgctggacttgtttggcaatgttccaagcggcatctgcagatagataggggtcgtaaccaattacattcatgcctagactcaatgctgcattggcaacgagagcgccaacatggccgagtccgatgacggccaaggtcttacccgttaattcaataccattaaattgcgtcttgtcgtgttctgtgcgttgagaaatatcagcttcggtatgctgggccgaataggtcgttgcagctattagattacgggatgccataatgagcaggccgatgatgagttccttaacggcattagcgttacttcccggggtgttgaaaactgcagtcccgttggcggttgcctgatcgataggaatgttgttaacgccggcaccagcgcgcacaatgactttcaacgatgacggtaatgtctcggtatgtaggttgaccgagcgaattaagtaagcatccggatgctcagattgattgagcgtgtaatcagcagtaaacgtgttgaggccggctggggcgatggcgttataggttttaacttgatacataaatatcctccttgattaacgatggtgtgcttcaaaagcggctagatagtcaactaatgcctgaacaccggctaacggcatggcgttatagaggctggcacgcataccgccaactaagcggtgaccctttaggtttaataacccgtgctcacgggcgccttgaatgactgcggcatcgaggtcggcctgacctgtgacgaatggaacgttcatggtcgaacggtcgctggtcttgactggattagtaaatagttgtgactggtctaagaaatcatagagtaaggcggctttagcgtgattgcgagcagtcattgtgctgagcccgccttgggcctttagccacttgagtacgagacccgcggcgtaaatagcaaaaacaggcggcgtgttgaacatcgaatctttagccgcgaatagctggtaatccagcatgcttggcaggttggcgacttgaccaattaaatcatcacggacaatgacgattgtcaaaccagcgggacccagattcttctgagcaccagcaaagatgagcccaaaatcgctgacttggtaaggttcacctaaaaagtttgatgacatgtcggctaccagtggtacttgacccgtaactggcaggcgcgtcatcatggttccttcaatagtattattagttgtaagatgaatataatcgagggattgatcgatgggctggacgaccgttggcagttggttaaaatggttggcagcgctactccccagtatcgtgactttagtaccgacccgtttagcttcatcggcggcgcgttgtgcccagtgaccgctatcaagcaacccgatacgatgatgaggcgccagatttagtggcgcagctgtgaactgtagcgtgcccccgccttgaaagaagagcacgtgatagttgtcaggaatggccattaaatcgcgaagatcttgttcggcatcttgaaggacttgcgcaaataaatcggagcgatgggagatctctaaaatgctcatgccggagtctcgaaatgatggtagctccgcttgaatttgagtgatgactggttgtggtagaacggctggcccagcagaaaaattataaattggcatgaaaaatcctcgctttcagtagtttaatcaaggtaataaaaaagtcctcgcagtcggtttcgactaccaggacggataataacgagattaagcaattccacctggtagcgaatgtcttagcatccgtgctcaggctgatttgcgtacgcaaaattaggccgacacagatgggtgtgtagaccaggaggaactgatatgatgattgataggattagttagaaccatcagttggacactccttcgttaaactggtgttagcaccagtcggttaattgcgttggtattaatttagcaagcacgtaaccatttgtcaagctagataatgagaaaaggctgtggcacaattagtattattaataataatttaatcttggaggcgcacgatgacaaccttttacgtggtacgacatggacaaacagcggccaacgcccaaaatttaaaacaaggcacgattaatacagctgtcacgcatttgaattcggttggcaagcagcaagcgcaaacgttgcacgatacgtttgatattagcttcgcggatcggttgatttgtagcccgcttgaccggacccaggccacggcggcgattttgaatcaaggccggcaactacctgttagccaggacgagcggttattggaaatttcatacggccagtgggatggacaggataatgatcagttgctagcggcctatccgcagtactttgatccacttttacaggacgttttgccaagctacgtggaggttgcgacggatggcgagacttttgagcacgtgcaacaacgagtagcagcatttttgaagacaacagcacaagcccatccagacgagcagatcattgtcgtgacccatggttttaccgtcaaagccatggccttagcgatactaaagccgaccgatccgatgagcttaccggagccagctaatacgagcgtcactaaagtaatggtggatgctgtccatggtcgccaatatttagcatattataaccgcctacctcaattctgacgcgcaatgacttaacgaacgggcgattccgggctacaatagatggtggtttgaaatagccacgcactgttgaaccttatttcaaatcaaagtctaattaggcagcaacagcagacatcacatataaactcctaagtgaggtggtcctagcatttggcgaggatcgcccttttgtatccgcttaagcgtttgatcagtaccaatattacaggcgcggtataatataaatagtattcaaaaattagatgaggtgagtaatgatgacatattcagcagcatcaacgcgctatgacgaattaccgattcgacgcgtgggtaagacggggctacagttacccgttgtctcgttagggctatggcgaaattttggggatgaagcgccgtttgccaattcacgaaaagtggttctagatgcctttgatcatggcgtttttagctttgatttagcaaataattatggaccatcgaagggatcggcagagcggacgttcggacaaattatgcaacgagatttaaagccgtatcgtgatgagctcgtcatcacgactaaagccggatatccggcctggtcagggccgtatggggctttcggctcacgcaaaacgttgatcagttcattggatcgtagtcttaagcaaatgcatttagattacgtcgacattttctactcacatcgtccagaccctaacatcgatttgtatgaaactgccgcggcccttgaccagttggttcgtcaggggaaggcgttgtatgtcggaatttcaaattatgatcgcgaccaaacggcaacgatggttaagtattttaatgagatgcacacgccgtttacggttaatcagtactcatataacatgttgaatcaacaggctcaaacaacgggcctgattgactatctcggccagcataatgcgggcttggtggcatatggtccattagctgaaggattattgacgcagcgctacttacaaggaattccagccgattttccgattcatcgaacgaataaatatttatttgatcaggggactgcagccgttgtcaatcagttgaatgccctgaacagaatcgctgagcaacggggacaaaccttggcccaaatggctttggcttggctactacggtcacaggtcgtcacgagcgtcatcattggtacgaccaatgtcgaccacttgcacgctaatcttgaagcaacgcacaatttaacctttagtgatgatgaagtaaaagctattaccgcgattctaaagtaaattgcattaaaggccactcccccaatatgccggggagtggcctttttattagcgcgtcctgtttattaaggtcaaaaatagctcactcttaggctcgttaggtagactcctgttcttcagcaataatcgccctatttccgacctccggggcggagcgacaattgctggaacgtaaaccgacatcgatttgagcccgaacccgcccagtctcaaatacgagacttattctaagctggcggcttttgaatttaatgacggtcatgttttgaactgagccatagccgtgcgctaacttcaactgaccgaatccgggcaattttaaaataatttgggcgaatgttcggtaacctcggtagttaacggcataattagttagctggtgaaattactgattggtacaagtgaccggcttatcaacgtcatcaaaatgtaatagtttttatcgaacgtacgttctaaaaatgtgctatgatggagctactatttcgatgaggtgatctaatggaacagctgaaaccaattgaagcgtcgttattgcaagcttatgagttaaactgcgtggttcggttaactttaagtgatggtcatcagccgagtggcttaattgcggctgtggacgaccagcagctttttttgaatcaacaagcgggagtcgttaagccgattgcgttgagtgacgtaaccgccattgattttcttaaacagtcttggtggcagcggtaatcctaaaggtcgtatttcgctatgatttcgtgacgacggaattcggtaatagcagtaatcaattcaagtggtaggggctgatccagcggaaactggatggcccctttgcttgttttataggtgattaattgatcatgaaaagtctcaattgcacttggcgttgggtacaagccaaagtgatgtttgaataaagcaaaatggatgacgttttcgtgccaatagaaggtcggcatctggtactttaactgctcttgcgcctctggtaagaccgttgcaatggtttgctgtaaggctattaattgcgattgataggcttgtggtgtgttagcaatataggcctcaatcggtgtcatggtgaatatcctcctggtcacgtaattcagcggctaaagtggcatccgggataacggtgatcgtgcgtgcaggaccactaaaggtgacaagcccagccttagcacccttgggtttacgcatctggccaacggtgagcacatcaacaggtacgcggttcatctgacgacccttactgtaataggccgtcagtacggccgcttcctgcaaggtttgttcactcggatgattactgtgaataaccacgtgtgaaccgggaatttcaccacccgcgtgcatccagtagtaatctttacgggccgtcaatgttaggtggtcgttttgacgactatttttaccaacttcaaccagcacgtggtcgtgcgtgtaaaagcggcggggatgggcgggtgttggggccttagacgagtgtaaaacgtgggtatgaatcgcgcccgcagcaatcagtgtttgcttaagcgcggcgaccgcttgtggatcattagggtcgaaagctgcttgagttgctaattgctggtatagttcggtcttggccgtcgccaaattttgttgaacggtcgcttgaccgcgtttgcttttgtgataacgatgaaaataatcctcggcattttcaataattgattttttaatatcgagtttaatactgagttggtggccttgatagtcgggcaattcgacgaaatgatggtgcccctcgatctggctagcatacgtcttcaataacgtgcccttgagttgcaaatcactgacatcaggcaggtggtctaatgctttagttaatgattcgatttgtttacgcgtgtggtgaattaagtgcgctaatccagtttggactaggtcgacatcggttgtggtcgtcattaattgggttcctctaatctgtaaaagttaacgtcttaataataacatgttctggttagttaacagtggaagattgggactagcgaatgaattaagatgtcaaatgacacgattgaaaaaagttgagcaattttcagaaaagttcggtattctattacatgggagttgattgagaaatgcaaaaaacattaattattaacgcaggtagttcatcattgaaatggcaattatttgctatgcctgctgaaacggtggttgctagtggtctcgttgaacggattagtatgcccggttcaattttcaccatcaagtatggtgaccatcaaaagtttgaaacgacagtcgataatttagatcaaaatcatgcggcgcagatgttattggctgaattacagcgattagcaattattgactcattaacggaaattacggcagttgctcaacgagtcgttgcgggtggcgaaacgttcaagcaagcagttgaagtgacgccagcggtactcgaggccattaaggggcttagtgactttgcaccattgcataatccgatggaggcacgtggtattgagacgatggctcaggctttaccgaccgttaaacagtacgcggtatttgatagtcaattctttaccgatttaccagaaatgaatgcaatttacagtttgccatatgaattgacccaaaaataccatattcgccgttacggtgaacatggtatctcgcatggttacttaaccggtcgggctgcagaactgctggctaagccgaaagatgacctcaacctggtgacgttacacttaggtagtggcgcgtcattagctgccgtaaaaaatggccgggccttcgacacatcgatgggctttacgccattaacgggtgtcacaatgggaacgcgcgcgggtgacgttgatccggccgtattgccattcctcatgaaagctttaaagatcgatgatccgaatgaaatcatgatgatgcttaacaatcagtctgggttgttaggaatctcaggaatttcaccagatatgcgtgaaatccgtgcgcaagaagccacgaatccccaagcccaactagctgttgaaatttttgtcaatcggattgttaagtatgccggtagctatttgacagaattaaaacgggcggatgcgctgatttttgcgggcggcattggcgagcataatgcgaccttgcgccagcaaattattgatgaactgagcatctttggtgtgaccctggatccgaaattaaatgaagcgggtcaagaaggactcatcagtggcgcagattccaagattaaagtgatgttgatcccaactaacgaagaattagcgatggtgcgacaagttgcggcgttgcaaaattaagcttctcttaatttacgactgcaatcagtctgccgctgtatagcgcgtgctatactaactggcaaggtacccatgatgggacttgtaaggagggaagctctcttcgcagagcgcatagatgatcggtttattgattgctttagtaattggtttatggttgctcaaagttatctttaaaattggttttaaaattatcggttgggtgttcatgattgtgattgggttgtttttatttaaaatcgcattatggttaggcctgatcgtcgtggcgattgccggcgttgcattattcggaaatgccaccacgtaatttgaaagataaagatgagcgttgttaaaactagtgtcatcggcacgctagccgtaaaggcggcttgttggaactaaatagtcattgaacaaaaacaggaaatctcagttagttttgtgagacttcctgttttttgagttagattaaagttccgagataaaccatgactaggccaccgacgagactcaagccaaagtattcccaggcgacccgttgatggtggttacggccgagcaacacgagttcgttgatcattgttgaaaaagtcgtatagccacccataatcccagttcctagaaaaatctgccagttgggcggtaatgagctggttaaaatccaaccgagcaataaagcgccggttagattgataaataacgtggcaattggtaacggccatcgattgagaggtagtgctaagcgcatgatgccgtaacgacttaaggcccctacagctgcgccggcaccggccaatccgactaggactaacattaaaattcctcctttggtagccaataggtgctaaggaagtttccagctagccccgctagcaaacccaaccctaagctagcagcgacataacttaaagctaaaacgctatgaccactttgaaacgattgtagcgtttcaaaagtgaaggtggaaaaagtagtaaagctaccaacgaacccgacactcataccgataacaatatcttcagagacgggtaaccgcgctggtaacaagttagtaatcaggctaagaacaaatgctcccacaatattaatcagacacgttatccagaaatgctgtggccaagtgacgagcaaactaagcccctcccggagaccaccacctagcattgcgaagccggtaattgcaatgatctttttcaagctgacacctgctttctgaaagtaattttagtttactgaaaaaacttttaaaaaacaatggttcttgcaaattgaaattaaacatgctaatctacaaagtaacttataaaacacgaggtattcagccaatgcgcaactaattaattctagtaactgaacagagccatgcctagcataggggtggactgtccgttttgggattaattagggtgctggtggaatcaattgccagcgttctcattttgaggacgcttttttgtgccataaattagtccctgcaactaaggggatgcttattaatgacaatgattaatttaaaaaatattcaaaaagatatggcgggacggccactatttacaattgaccgattagtcgccaatgccggggataaaatcggcgtggttggccggaacggtgctggtaaatcaacactggcccatttactgacgggtactgatcgtgattatacggggcaaattatggtggacgagccagtcagctatgttgcccaaatcgcaccgacttttgaccgaagtggtggtcaagctatgctaaccagaattcggcaggctttgagcgcccggccaacaattttaattctagatgaaccgtcatctaatttggatgaaacacatcagcaatggcttattaatcagttacaacgttttcgtgggttgctgttgttgatttcacatgatcggcaattattaaatgctgtgacgacacagacttgggcggttgaacaccaaaaattcaccgcatatgcaggcaattacgcatattatcagacggtaaaagcgcagcaactcgcaactcagaaagtcgcgtatcagcgccaaaacactcatcagcgtgagttactagcagcgcagcgtcaacgtaatgaaaaagcccagcggattcgaaaaggcaatcggcgaatgtcgcaagtagagcgtgccaagacgaaagcgactagggaagctaccgcggccaagatggaacgaacggctaaacgcatggtcgcccgaggacaacgggaaccgcaagttgctaagccctttacgacttcaggctttaagttagtcgcgacagattttccgacgtttacaggtaagaccgtggtaactggtcttaatgtcacattggctgaatatggaaaaacgttgttagcacacgctgactttcaaatcaggccacatgatcgggtcgctatcgtggggcccaacggtagcggtaagaccacattactgcgtgcaattttaggtggccgggtgtcaggattacgattggctccggcggcacgagtcggagtattcaaccaagatatgacagtgctcgacggtaaacagtcagtgtggcaaacggtgcggcaagtcagtcagctaccggatcaaacgatccgtaacgtcatgggcgcgttgggcctgccagcacgcttttatccgcaactggtatcggcgttaagtggtggtgaactagttaaattacagctaattcgtattttagtcggtcaatataacgttttaatgttagatgaaccaaccaattatttggatgtggacgcgctggatgcgttggccgattacttacaaaattatcctggaaccgtaatttttgtttcacatgatgaaccgttttgccaggccgttgctactcgggtattgcaattcgagacgcaccaattagttgatcctgacaaagttgttaaagcgccgcaaccggtagaagctgacttagcagtacttcagttcaagtatgatcaattaatggcagacccgacgtcttctacagctactattcaggcattatagcaacaaattgatcggctgaaagcatgacacgttgtttagccttgaagcattcccaatttccatacacagaaatccttttgaaatttcctttaggtgttaaatcggaggctatcagtttgcgataggtgttaacaaaaactatagtaaaattttagttatattaagttgaaccccaaagattgacataaatcgaattttaggggttcaatttatttatgtgatgtttgctgattttgtgagtaacctatactctgagtcatcataaatttgtttgacagtcgataaatttaaaataatcattatagatcttggtctatttgccaatccggtcaaaaaataatagtccttattcaattgtgatagcatttttacaatggatattattatggtaaaataattcaaatataacatatggtttgtttgaataatcaactaatttattttgacagttaaatggggtgtgccaaaaatgaaaaatggcgatctaggcggggcaaatgctgctataggatttcgacatcagtattatagtgcgattgatgcggtaatggaacatatagatgatgcggactttaaaggtattcgtttagaaggtaaaaatgattttactttggtttttaatcagactaatatttctgttcaggtgaaatccaataatccgactatttggggactaggaaaaatagtaaataagctgccgcttaatatggaaaaatatttgatttatttatcgggcctaactcctagtgtaaagagccttattagtaagttaagaattgtcaaaaatgatcctgaagaattagaatcgttaacagatatttttactcaaaagatgaatcttgatccggaaagaatcaaaataatgtttttatgtgactttagagtttatccaagccatggcgaggaacaaccggccttaggtcgtattgcacaatgggcaagtaaaaatagaattaattgtgatgtagttgcaacgttgaattcacttatggaattatttagcaaattgagcacggagtgggggtttgtatcaactgaaaaattaaaaaaggttatcgaaaacaatcgttatatacccgaattttcagccttggcaatgaaccaggatgctctagggtttaattccgacttattagatgcaattgattattttttaaataatgtaagttcgaatcaaaatacagtgggagcgttaagaaatctaagattattagtggtaaataataatttagacatgagactggctgctagaaatttggccgatgagaatcctcgatatgaaattttacgtgctggagtttctttattcacaagtggaaaaattgactttaatgttaacataaatttggtgccagctcgattattgagctttttgaagttaactagaggaatagctgcacttaatacagatgattattcagctacaattaccgactttgaggatatacagactaataaaattatagtgcatacgaatttaccgtatttgtgtggactatgccaagttaacttaaaagactattcaaatgcaactaagaatttcaaaattgcaagtcgtttgggtagttcaatagtacgtgcagatgcttattgtcaactatttatgttaaagcaccaagaagatcctttttttgccgacttttatgatttggattgtgcaaaagaaattttaccaacatattcacgtagttatgtattagcgattaaacagtatgtgtttctggggaagtttgatgacgctatgcgtgattttagatacctgcaaataaatagcctgagtccaaagacgaagcgtgaagtttatgaatatattgccatagctgaatctcatagcgaaaatatacatgttaaaacagccatggttgactatttgaaaatacttgtgaaacagaatcgttttaagctaaaggaaggtcgcactatagggtttgtttttgttgcggcttattttacggatatatacagagtttacgcaataaaaggtggatatggcttagatatgggacggcaatgtataaaaattgaggcacgttcagatatttacgcatcaaggatcggcttgcataccatcgttccacctgttgaggctcttttaaatcttagtcttagtgacgaagtgaagaatcttgaagagtattatggaaaaagtatatctgacttaactgttgaagaaagacatcgtattgttgattcagcggcttttcaacataaatatggtatttcaacattgcttgttctcgaaaatacagcagatgataacgaaaagcttctaaaatccgagcatataggcgtgaatcacgagtacccaaatataattgagtatgtaggagataatcaggtaaatgccagtattaatcttgaattctattttgaaaaaacgactggaacaattgatattaatgatttccattgtatttttcatattgacagagtaggaaaaagtactcatgagttcaaacggcgtttaagaaagaatgggtttcatcaggtgattatccttattcccgggaacaagaagcaaaaagaaattttattatatttgcctgattcgtgtgttaaaactgttgatcacgactgatatgaaaacattattgttatgtttcaatcggaaatttggcaaaaaaggccggtctgtaaaaatcttcggattatgacagaccggtctttgttatggagactgtatgttacagtctcgttttaatttagtttctgtttagtgcatgctgccagctagcgccacggaatgacgaagacgccgacttgtaaaagcaagacgccgctaatcacaatggtccaatccaacttagtcagtggaatctgacgatagtgagtgcggggtgcatcttcgataaagccatgggagcgcatggcctgggcaaggttctgcgaccaattgatagagaccaaaattgctttaaagtagagctgtggtgaccagaaggacaggacttgcccacgcatcagaccagcagcccgaatcacttgaacttcgtgctgaatccgaggtaccaagttatacgcggcgaggacgccatatgcaaatttggcgggtaaatgccagttctgctcaagcgagtcggttaattgtaagacgtcagtcgtgagcgtaaaagtagcgcccgtaaaaacaaacgcatagattcgtgtgaacaggacccaggccatcaaagtcttgtcaccgctaccgttaatgtactgggtactccaaagtccaattgctggtagcaacggaatgagtagtaaccaccctaatgttcgaagccgcgttcggtgaccgagcaggtaaatcagtgccagaataatcagtgccacgttcaaacttacaattgtcgtgaatgaaatttctagtgcaatgatgagtagtaataataatttcatgctaggattcatgattgcaccacccaatctaaatggtgattttcaaagtgtagctgatagtcaatcaatggcattaggccggttaactggtgactgataataatcagtgtctgcttagttgccgcttgggtggtctgtaataacgcgaccagggcattgatcgaatgcaaatccagcccttttaagggttcatccatgagtagcactggcgactgcatgattaacatgagcagaatttgtagtttctttttctgtccctcactcaaagtatagatgacttgttcatcacgaccggataagttgagttgcactaaggccgtttgaatacggtccgcggtaaagtagtcgccatacgcatagcgtttactttgagccagttcttcagcgaccgtgatgtttaaaaactgggtctcagcgtcctggaagagcaaggcgacatggcgagcatagcgtttgcgttttagcttatcgataggtgtgccttcgtaacgaatttcgccagtatagggatgcagacggacgagggcttcaaataacgtggatttaccgctaccgttaggacccgtgatcagcgtattgtgttgtgccaacaattgacgcgttgtcggtactaatagttgacgatcacctgcctgtaaagtgacgtgatcaagttgaaaacaagggtgttcaacgcgttgcggtgctgaccatgaccgttgtggctgctcagtaaaggctgaaaataactcagaccaggtggtgcggtcaatgagctgtaagtgctggtccttgatttggacgacttgatcgacgagccgttcgtaacctgttaggtcatgatccgccaagatgattgtcttcccatgttgattgcgtagttccacgagtcggtctaacaagacggctcgtgcggtcggatcgacactggcaaagggctcatctagtagaatgacatcgctatccatagcgacaatgattgcaagggccactttctgtttctcgccaccggataaatgatttaatagtcgtgactgtaaatttcggataccaacaaagtcaagcgcactaagtaagcgggccggtatttggtcacggggcacttgtaagttctcaagtgcgaaaattagttcattttcaacggtatccatggcaaactgctgattaggattctgaaacatcatggcaacgtgctgagcgcgctgattagcggtgctagcagttaatgactgaccatcaaaggtaatggtgccgtaatctggagtcaggggtagtaagcctgcaatcagctttaggagcgtcgacttacctgttcccgatggccctgtcaataggatgaagctttgccgtggtagtgttaggttaacgcgatccagaatgggtgtcgacgcctgtggataggtgtaagttaaattattcagcgcgatactagccattcgagaaagcctccattttataaagtgtattaatgcgttgattttaaaacatgactgcgatcaagtaggtccgtgatggttttagttaacagacccccgaaaacaaacatcgaaataaagcgaacgaccacgtataaaatcaagagccatagctgtaatttatagtaaccattacgggcaaggtcccagccaaaggtgaccacagtagttgttgcggccgcagccgttaagcctaaccagtcatagtgtttgtagccagtgacgatataacctagttcggccccaaatccttgcacgacaccagaaatcaatgtggtgattccccattgaccaccgaaaaacatttcgacggttgctgcgaggagctcacctagcgttgccgaaccctttagtcgaatgaggtagccagctaacatgccgggcatgcaccataagccaagtagtagttcattagccagaccgcttagaccaaatggtgtcagggccgcacttaaaatgttataaacaaaattagtccccataaagatggcaccaaagaaaataccaattagtgccagtaaaataatatcgttcaagtaccatgatttaacccatttcattgttaaatcctcccaaaagtagtttgtcattcacgcatccaagcgacaaaaaacgcctaccacgattatcggtggcaggcggctaagtctgaattgatggttccccaaataaaagcattgctccctgcgctggcattgtccagattcaggttcaatgggtattatctcagccgtgatggcaccccagttgctatgaatgatacgtttagtgtaacggataatgacattcagtgcaatcaattttccggaaactaaagcaaagtatgatgaaaagtcacaattttgtggtttactatggataaagcaatgtatttggttaatattcttaggagggatctcgatggcagaatcagtgtatgattttacagaaactgagatgagtggtgcgccacttgacttgtcacaatatcgcggtcaggtcttgctaatcgtgaatacggctagcaactgtggcctggcgccacagtttaaaggattagaagaactttatcagaagtatcagcaggagggcctagtggtcttgggattgccatccaatcaatttcatcaagaaaaggcggatgacgatgagatccatgactattgtcaacggcactacggggtaacgttccccatgaccaaacgggtgatggttaatggtgatgacgctgatccgttatttacttacctcaaacaggcggcgggacatggccgaatcaagtggaatttcacaaaattcctgattggtcgtgatggccgtgtgctcgaacgctatgccccaacgacacggccggcaacatttgaagcagcgattcgtgatgccttggctgatcgttcagaaaattaacgataaatttaacaatgatcgtttaatttaaaagaaagaagtggcttaagttggaaacttatacgttacgtgatggtttaacagtacctaaaattggctttggaacatataaactgaatggtgctcatggtgtgcaagtgatcgactcagcgattgatcgcggctaccgattattagatacggcctttaactatgaaaatgaaggtgctgttggtgaagcggttcggcgttcgtcagtaccgcgttcggaactcttgatttcatcaaaacttcctggtcgccaccacacctacacggaagctatcaatacgattcaagaatcattatatcgagctggcctggattattatgatttatatttgattcattggcctaatcctaaggaggatcattatgttgaagcttggcaggcactgattgatgcccagaagttaggcttgattcgttcgattggggtctcgaatttcttaccagaacatttagaacgattaaacaaagaaacgggtgttttacccgtcattaatcaggtcgaattacatccgtactttaaccaacaggcacaacgggattatgatcaagcacacggtattttgacgcaagattggagtccccttggccgggccagtgagatgcttcaaaatgagacgctcaaagagattgctgcgcactaccataaaaatgttggtcagttgattttacggtgggaactacagttagggaccttgccgattccaaagtcgtcaacgccgagccgtcaagcaggtaatatggacgtgtttgattttgaaatcagtgcagctgatatggcaacaattaatggtttgagccaagtggatggtcgcttgaataatcaagatccagcagtgtaccaggaattttaatttgaatgatataaaaagatagcgacgttgtgatgataactcgtcgctatctttttatgggcaactgcttgttgatgattggtttgtgatatcagcgtaatcgcaatacatggtgcagtagcgattggctgttttcatcttgaaaggtcgtggtagtatgacaaatacgtttcccacactaggaaaggttttcagccgtggtcactctacctgttcggtttgctttcttgcaaatcattttgagcatcgcactagcgatgtatcaggtatggaactccagaaacaaaaaatagccaccccaaaactttggccggtattgggtgactgttctttgattatctaaatttaaagccaactgctcttagagcgggccttgattcaagtcggtattaacgtatcggcttttttactgcctttatttaacacgtatgcgcttcagaaagtgtatttttgattcaaaaaaataaagataagcttccaatcgattggcataactattttattacgcgcgcttaaccgcgattaccttaacttgataagccccgttcggtgcgttcacagtgaccacatcgtcaacagtatgattagcgagcgcttgaccgatgggagatgtgaatgagattttttgttgttcgagattggcttcctgttttccaactaattgataggtgatttggtcatgatcatccagaaattcgatggtcacgaatttaccgatatcgagttgattgttgtcagctggttgaacgatttgggcgtattgcaactgcttgttgagataacgcaggcggctttctaagcgacctaagtcccgtttggcactactatattcggcattctcagaacggtcacctagtgccgcagccgcagccagaattctgattcgctcgggccgttgttgctttaagtcttcaatttcctgttcgatggcatggtaaccagtcgaagtcattttgttaaaagttggttccatagcaaaaacctcgtgtccgttgaatttctgggaatagtttaccgcaaatgtgattagaatggtaccgtctaggtgatatctgatgttaatcacgatcgcgcaggtggttgctatacagcatgataccgctagtgacggtggtcagggcgataccagcgatcagactaatgaacggctgatttatcgcaatcaggaagtagaatagggcggtgaaaccgattagttcaatggcccacaggccaaggtagcgccatgaccgtttgggtttgtcttctattggggtgctgacattaacagacaaaatgatcatggtaaaaacggcaatcatcaggacaatatacaacggattgtcgtacgtaaaggctttctgaagattgtttttttgccagccttgccaaaataaaatcagtaagatagcactattttcaattaacaacgtggtacggatgttcttgaaattttgtaaaattaaacgttcgtcacgaatctttttcatggcagggatctcctaactgggttcgacccaaaagacagtatcgagtgtttggttgagtgcgtgacagaggttgaggcagagtttcagtgatgggttataggtgcccttttcaatcaaactcagggtttgacgggtgatgccagtcttgctggcgagttctttttgtgagaatccggccattaaccggtattgcttgacatgattcgcggttaacatctccctttatgtaatatatatcttccatacaaagctaattttagcagttaccaattgcaatgtaaatgttggatagtttgattgaaatgtgaacaaataaatggttggcgtagaggtatgagcgcaaaaaaatagccaatgactttgcagccttggctagtcgtggaatttctcacgttccacggagttacgaacatgttaagtataggcaaaattatcgaaaaatacaattaatttattaaaggagtttggcttgacagtttaacaatgataacgattgcaaaaaataaaagtgaaatatttcagacaaacctcttgaattttagtctataccaatatacaattggactataccaaacaaagagggagtcagttaattatgaaagttatcgtagtaaaggatcaagctgccggcggaaaagaaggtttcaaagtatttaagaatgctttagacaatggtgcgaaagtatttgggttggcaactggttcgacacccgttacaacttacaaagaaatcgttaatagtgacttagatttcagtgactgcacatccgttaacttggatgaatacgttgggattgcaccagacaacgaccaaagttataaatacttcatgcaaactcatttattcaatgacaagccatttaaggaatcattcttgccaaacggtttagcttcagatccagaagctgaagttaagcgttacgacaaagtgattgacgaacacccaattgacttacaaatcttagggattggccgtaatggtcacattggttttaacgaaccaggtactcctcgcgatattacgacgcacgtggttgatttaactgaatcaacgattgaagctaacgcgcggttcttcgccagcgaaaatgatgttcctaagcaagccttctcaatgggcttagcttccatcatgaagagcaagcacttattgctcgaagcattcggcgaaaacaaggctgatgcggtcaagggtatgattgaaggcccagatacccctgaattaccagcaagtatcttgcaaaaccatccagacgttaccgttatcattgacgaagcggctgctagcaagttaagcaagaagtattaattttaattaagctaaaaatgatttgaaagccgtgcttcataacgattgcgttgtgaagcacggctttttaactttgtcggtcaagtcggttattgtgccgccgttactaattttttctggaactgaaatcccatacatagtacacctaggatcagcgcaataacgccgctgactacgaagacgttaatacccataccagcaactaatttagtcaatggattaacgatgaaaggactgaccacacccccgattgagtaaatcgcgacgtacacacctagggccatcgaaacactgtttttgccaactgaaattgagatcaaatatggaaattgtcccatggcgatactcattgcggcacccacgatgaagctacctacaaaggctaaccatagcgaatgtccaagaccgattaacaggtaggacaggccgtataagataaacgagattgtgatggatgagtatttgaaccgcttgccgataacgccaacaatcaagccgcatagcatccccccaattaatgaaacggttgacgtcagagcggcttgtgaggttgcgccaagtttttcttcagcaacaaatagtgaaatgttgttgttcaaaacattatttaagagtaacgtgcagaatccccagaaggcacagaaaaagacgtatttgttgagcttaatttgttcaccggtatcctgatcgttggctgcattgactgctgccggatgcatcggcactaatgttaagatcacaatcaaaataagtgctgagaataagtaaatccaataattatttacccaaccgttcgttgcagctagctggccgccacccatgatgaagacaataccaccgagattggtgaaggtggttgttaaacccatagtggactggcgttcggtttctggtagcatttgagaaattaagacttgtgataaattggtgcaggcgccttgacctagaccgactaagcacgagcaaaataacaaaaacatgaagtttgtgtggaaggctaatggtagaaaaccaccgataattactaagattgccgcactaagggttaatgttttgagattgagcttggttgccgttagtttgcaaataatcaaccctgctaacatcataaatagattaggcaatgatgttaacatctggacactcgtattactgagtgaaaaattggatgcgattgctgcataggatggggtaattgcgagtgccgccatgcccattgaactgactgcaagaaccccaatccgggtcttagaaacgtagcttttacctggtcccgatatcgattttgttgtttccatgctggacatccccctaaataaaagactcaatattggatttatgatttagttgacagtggcgaactttgctttgacgtaagccgcggcacttgttcctgcaattcggcccgacgtccaagtaaagccagaggcaaggccttcaaatgcaggatagctgtgtccctcatagtaaccaccagcattggcgccaccagtataaagaccgggaataggtttgaaatcgtcatctaaaacggcgagatttcgattgacccgaacaccaccgaccgtaccaagataggcggcttggcagatgaaggcgtagaagggaccatcactaattgaataatccaaggactgcaagcgcttactgaattcgctgtcgtttttggacgcgacagcttgattataagtagcgacggtctggctcaatgttgaaggatccataccagcattagtggctagctcagtgagtgagttccccttaaaagctgttttaccagtgacagcatcttcagctaatgcggtaaagtcaccactgccagtcgctgcgcccggtcctgcttgagacacttcttcgcgattgcggttggtggtgaatgtattgagcgtggcctgatccacgataaagagatattgaccaccctgagaccaagcagcgttcgcccattcaacggtatcgtagaccacatcttcgttggtgaatcgttgtccctgcatgttgacccatagttgaggggttaataataattgggttaatggattaccggaaaaaccagcaaggtgttgctgagaagtcttttgagtgacttgggatttagctagttgcgcagcatgaatgagcgcatggctgtcgatgtcagtaccgccagctttaaccatagcagccagaccttcaccgttatttggaacacctaaggttcttagatgcgtggtgtgcatggttcgagcaactttttcacgatcaccaccgtacccaccggttgccacaacgactgcgtgggcggtgattgttagctggtcacctgaagcggtcatggctgttgcgccagtgactgctccgttggtaattaccaggtcagtaaaggtcgtattaaagtgaaaattgacaccggcagtcgttaatgtttgttggatgcgctgatagctctcgtctttatgttggtacatatgataggaacccccacgataatcattattacgatgcgcaaactgagtcgtattggcagttgggttgagtttgatttccattcccattttttccaaccaggctaaggtatctgccgagcggttaacgatccgcgcaagtagggtaccattggacaaatagtgattgtagtcggctaattgtgtaatggcctcctgagttgttaggtgcataccggcttcccgttgttcacggctattaatggcgaaaaatccacttgagatttttgtgttaccgccaatttgtgattgcttttcaataacggtgactttaagtccatgggtcacggctgcgtatgcagcggctagtcctgtaccacctgtgcctgcaatgaggacatcagtatcaattgttcgattagtcataatagttgcactcccttattcgaatttacaaagttagtataaagctaaaatatgcacaagttgatagtgtataatatccttattaatatgtttatatatcttttaagggattgacaggtgatagtgatggcttctataaatacggtaaatagcaattatcaattgaaagaaagcgattttattggtctacgccgtaatgatctttcaagttcaccaaattgcagttcagagtttcacattcgctttatcgtgagccacgatttcgctgaattaacattagccggaaagtacgtggcactgtccccagatgatattgtaatggtttcatctgcgcagccaattaatattattaataggggggcaccagtaaagttaagtgttttttcggaacgtctgcatgcgcctacgccattaaacttggtggttgtcggagataacccaatggttcatgatttaatgaatgcgggtgagcggacattgcggtttattgtttatcgccaattgcgaaatcagataacccaacggtactttgatttgttgacggagttagaacggcaagatttgcaagatgtttttattgattatcaacgagaaatgacggtgggattgttaatgacggaactattgcggcatcatgaggaacgcatctcgattacggattcttattttcctggtaaaaatattcgacatgttaatgctgatacgcaatcagggatgatttttacgtatttagtcgcacataacgcagatgcgacgttaaaagaaacggcatgttactttggatatgataaaaattatttttcaaggctgtgtcgacgactgttcaacaagagcttttcggaacaattaacatttattcgtattgaactggccaaacgaatgctggcattttctaataagcgaattgaacaaattgcagctgaattaggctataaaaataatagtagtttctttactgcgttcaaacgcgaagtggcgataactcccaatgattatcgtgagcagcatgggtatcggttagcacatcagcatatcaatgataattaaaaacacaaaacgacgtgctactgaaatgttccagtagcacgtcgttgatgatttttttatagattttgtcctttttcccaagtcgttttcgataacaacagcccttgcttaaccaaagtatcaaacaacgcatgggtccggttggaaatttcggcggcggtttcgctattggctttggtcaagaaatcggtcggattgccggcaatggctgcgtcggttgcggcaacccggccacgggcatatgattggcacccgtcgcgataggcattgaccgtttcagcaaattcatgccagtgtggttcaatcaagacggagagcgtttttgataaccagtagacgttatcaacgctgaccgtgctagttgtattgcgataatcaatcggcgtgtcattgatgttggtaaagaagggcacgtatggggcgtaagcgaagaaacctagtgcgatccattgaatggcggcttgcttagcaggcacgtcattccggatttgcagaatagatgagcactgattgcgatccatcgcgatagaccggtaacgtgtttgttcacgggcgttaccagaagcgaaagtgccaaatggatcgtaaggcgtcccgttatagtgtgaagataagaagaactgaacgtcttcaatagccaattttttgcttggttgtcggaatagcggcatgttttgatcagtgggattctgttcgatttcgggattaaatagtttttgaccataccatgttcgcggagtgttgtaataagcatccgcctcactttgggtaccaaagatttcacggaaattaaagtgaccgggtgttgggttgaggtgatacttttcaacgaagtccactaaatcactggcacctaggaaattgtcggtatcgttgagatccatctcttgcaccacggtttggttgggaacaattgcgtaggtgtcttcgggcatccgaactgccccccaatggtgaccaccggcggtttcgaacaaccagatatcgtcgtgatcgttaaaggcgatactgttgctttcaccagttccgtatttttcaattagggcacctaagcgttggacaccttccttagcacttttaatgtagggtaaaacgagggtgaccatggcttcttcatctacgccatcatggacgagcggatcataaccgagtacgcgggcattggtggcagtggtttcagttgcgctcatcccgacatttaattcgttgatcccagcttcctcgtactgcccatcgctttgatcggcttggggggttgcggtgtagcggtaggcatggtcaggcagcggaacggtgacgccggtagttacggaagtgtagctggcgttagtttggtcgtgggcttcgtgcacaataaacttaatcggattaattgggccgtagccatcttcgttgcgggcaacgatggtcgaaccatccatgctagcagctttcccaaccaatatttcggtacaatcagtatcttttttcattacataggtcactccttagttaattataagtataggagcttgcgaggggatttcaacgttaaatcgtattcgtaatcatttaaataataaaatgatgagagaattgccaggtgttttctgcataaaatgttgaatttaattgtgaaaatgaaatcatagctgacgaaacaagtttaattagtctgctggtattgccgatataaaagtgtttatcgatactgtgccaaattttaactttgtgaattagtgagtttaattgtggcacagtttcctgtgccacgggtctaactagaagttcttgaaaccgcttaccacgatggatatgattaagttgttaagaaaaaggaaggagctttacctaatgagtgaaaatgtaaatacgaatgcaacccaaagcgctcctgttgcgaaaaagaaactgggcgttaaggcacgcgttcaaaaatttgggagtgcactaagtaatatggttatgccgaacatcggcgccttcattgcttggggcttaattaccgccatctttatggctggtggttggtggcctaatgctggattagctaagatgattcaaccaatggtccattatttattgccattattgatagcgtttactggtgggactttgtttgccggtcatcgtggtggggtcgttggtgcgattgccactatgggggtcatcgttggttcttcaatcccaatgtttatcggtgccatgattatggggcctttaggcggttggtgcattaagaagtgggatgacgccatttccgataagattaagagcgggtttgaaatgttggttaacaacttctccgctgggattatcgggatgttactagcaatcctgggttactttgcaatcggcccattggttgctggtgcaagtgctgctatggctgccggtgttgactggatcattaagatgaagctattgccattagccaacgtcttcattgaaccagccaagattttattcttaaacaatgcgattaaccaaggtatcttaacaccgcttgggattcaggctgcatctagtgcgggtaagtcaattctgttcttgctagaaccagatccaggtccaggtcttggggtcttattagcctttgccttgtttggtaaagggactgctaaggcttctgcacccagtgcgattattattcattttcttggtgggattcatgaaatttattttccatacgtattaatgaagccagcattgttcctagctgttatcgctggtggggttactgggacagccacattcagtttactaaacgttggtttacgttcaacaccttcacctggttccattatttcattactattaatgtcaccaaagagtatttctaactacattggtttaattatcggggtaacgttagcaaccttagcatcatttatcgttgccgcaattgtcttgaaacgtgacaagtcgaccggtgatgatgacttagccgctgctcaaggtaaaatgagcgacatgaagagtggcaatgctgaagctgctagtgcgactgacgctgaaccagctgatgtgattgcttcatacaaagatgttgaccatattatttttgcctgtgatgccggaatgggatcatccgcaatgggggcttccttattacgggataaagtcaagaaggctggcattagcatgtccgtcaccaacacggcgattagcaatttgaaagacgaacctggtttattagtgattacgcaaaacgaattagctgatcgggcggctcaaaaagcaccacacgccttacggttagccgttgacaacttcttgagtagtccaaagtatgaccaagttgtggttaacttaaaggctcgtgatcaagttagcgatgctgcacctgcatccgcagcaccacaagcaacgacggctgcacccgacgacctaccagctaacttagatttgagtgttgttgatgaaattgtctttgttcaccacgatggtcatttaggaacagccacaatggcaacgtccttgatgaaggatcgggtcaagaaagccaacaagcatgtgagtgttaagaacttaggaattgacgaattggctgataataatagtttattagttgtttcaagtgcagaagcagctaaaaacttaaagacccgttacacgcaggtccaagtattaattactgacgatctattgagttcacctaaatatgataagatggtatcagaattgaaataaaatgatattattaccattatcgtatgaggtggcatcatggttaagtttacacaacgtcaagatgagttgctacagctgctactagcgaatcccgccggcctttcaatgagtcagattgaaaccggtctcaatagtagtcgccgaacaatttatcgcgagttcagtaatttggaattggtattagccaatgctgatttgaaaattgttaatgagaagcatcactttcaactaagtggatcgcagacggccctggccaagtttcaaagccaattgacagcagagcggaagattgcaccggcgtttgactcacaaacgcggcaaaacgccctagcttgtcggttactgatgacgggccattccgtaaaattaaaagaacttgcgcttgactttgatgtgagcgttgcaacgatttcaaacgatttgacggcattagcaacaccattcgctgactacgacttatcaattgaacggttgaagtcccgggggattcaggtggctgggactgagggtagtattcgcaatctgtttgccaccattttgaataatgaaatcaacgactacgagttttttaaaacaatcgggaagttgaaccaaggcttagcaatatcagcaagtgatgagcaatcgtattttttgaacttactggacgcccaaacgttgattatctgttatcaagcagtgcgaagtttgaagaaaaagtacttttcttcggtgccggatggtcagctacaacagttgatcatcacgttgacgacgggagtaatgcggttacagcatgaacgtcgggtcacgtatttgcgcgggatcaatcgggatgatttcttgaaatatcaacggattgctctggcaattatgacccaactacccgctgagattaagacggtggtgacgggagctgaaattgattttctcgcccagcaaattaagggcttgacgtttcgaatcgatcaagacgcgtcgctatcgaattatgatttgcaactaacgtatcgggtcaaaaagtttattgacgcggttgcgactaactttaactggtcgtttgggacggatgaccgcttgttgaataacttgacggcgcatatgcaaattgccctacaacgtaacggtgttaatggtcccgtgccgccaaccgctgagttacaagaggtccgtgaacagtatcctaagctgtattcggcggtggtgcgcggcttcgcaacgatttttaaagaccaggattttacaactgatgagttgacgtacttgttgattcactttgctagtacgtatgagcaacagttgagtcaccaagcactcaaggttttggtcctgtgcccgaatgggatgacgacggcgcgaattttgaaaacgcgactgatgcggttagtacctgaaatcacggctatcgaggttgcgcggattggtaatttaggccaagttaatttacaagactttgacatgattttatccacgacaacgttaccgggatttaagttgaattaccgcgttgtcagcccactgttactagaaaacgaagtcactgccttacgggaatatattcatcagtattttccaagcaccaaagtgatcgattcaccggttgatgagccgacgaaaatcaacttggattttgacaccgtttaccaacagatgacgattgctaaacagatcttagaccgtttcactatcacgccgattcgcaacgatgatgagacggtggccgagatgctagttaagatcacgcggcatattgattcgaacttgattcatgatccgctagaagttgcgggccggttgttacaccgcttaggactggcgccggtcggtattcccaatacgaacttggcgttggtgcatacgttaagtcaggaagtcaccgcaccatattgtgcgattttcgaacttgaccagccattaccatttaagagtatggacaaccaatcgattcggttgcagcgaatcgtcctaatgctcgggcccgccaatatcagcgattttgaaaatcggttgatgggtaagttaagcgcactagtcattgaaagtcaggccaatacgcagacgtttatgactggcgatcgccagcaactttatcaattaattagtaaagcatttttgaacgaactaacgaaatagcgtaggtgaaaacaatggaagctttagataagaaaatgattgcgttgaaccagcaagtggctacgcaagaagaaggcatccgcttagccggtcaactattggtcgatggcggttgtgtcgaaccagaatacattgatgcaatgcaggctcgtaatcaggatgtctccgtatatatgggtaatttcattgccatcccccatggtactgaagatggcatgaagtatattaaaaagaccgggatttccgtggtccaagtaccaatgggtgtgagctggggtaatccagatgataacgatgatgataagactgtaacggttatcttcgggatcgctgggttgaacggtgaacacttgaacctcttgtctcagattgccatatactgcagcgacgttgccaacgttgctaagttagcggacgctcaatctgaagatgaaatcataaatctattaaaggaagttgattagcatgttagacgtacattttggcgcagggaatattggtcggggcttcattggcgaaaccttggctgacaacgggtttaagattactttcgttgatgttaatgatactttgattgacgaattaaacaaacggaatggttataccattgaattggctgcagaaggtcaaaaacatattgaagttcacgatgttaagggtattaacaacggtaaggatcctaaggcggttgctgaagaaattgcccaagccgatatggttacgactgcgattggacctaagatcttgaagttcatcgcgccattaattgctgacgggttaaagttacggcaagctgacaacaatacgacaccaattgatatcattgcttgtgaaaacatgattggcgggagtcagtcattaaagaaatccgtttatgaatcattaaatgaagacgaacaagcttgggctgaccaaaatgcaggcttccccaatgccgctgttgaccggatcgtaccgcttcaaaagcatgatgatccattgttcgtttcagttgaaccattcaaggaatgggttatcgacaagtcccagatgaaaaaccctaagattcaattaaagggtgttgattatgctgacgacttggaaccatacattgaacggaaactcttctccgttaatactggtcatgccaccgtagcctatactggtaacatgaagggctacaagacgattggcgaagcggtcaaggatgacagtgttgttgaccaagctaagcacgttttaggtgaaaccggcgacttgttgattcaaaagtggggctttgatcctgaagtacaccatgcttatcaaaagaagattttgagtcggtttgaaaacccatatatctctgatgatattgaacgggtcggccggacaccaattcggaaattgggtttcaacgaacgtttcattcgcccaattcgggaattgaaggaacgtggtcgcgattacagcgccttagttgatacagttggtgaaatgtttttcttcaactatcctaatgatagtgaaagtgttaagttacaacaattattgaaggatgaaccaatcgaacaagtcattcgcgaaacaactgacttgaaagatgaagatttagttaatgaaatcaaagctgcgtacgaaaagcacttagctgcaacaaagtagttcgataaaaaaactaattactaaccgccatggtaattagctgcaaaaggcgcccagaaatttaattctgggcgccttttgcgtcttgcctgacaaagaagcacttgatagcagccatcgctgggcgagttaactggaacgatgaacgtgtaggtagcttatttttaagactggcagcacacgttaatttggatggtaggtaatgctaactgttgccctaccgaagtaagtctaatgagcaagtatgttgaccagcatacggctacttttcccagaaatgccaccaaggtttggccgcttgactggcttgttgatcaagttggtcaaggacttggtttaagcggtcactgagtgaatctaagcgccggatgatcatttcttgctgcttatagagctcagcattagtcgggccatctggcttggccgctggtgccattttgctgggatcgacggtggttgtcgtgatgaggggcgacttggtggtagttgcaggcgctgatttctcagactgagtcgtcgttgccgccggttgtttggatgtcgggaccttagcaccaaacgcccgtcctagcgcagtggctaacgttgtgccctgttcagcgagttcgatggccgcctgaaaagtttttaaatcagcggctgtatataagcgatgactgttatcggccgggcggaagcgattttcatcgttaagctgtttttcaaccatggtgctatatttgcgcaacgtcacggctttaataccgagttgttcagcggcgacggaagcgactaattcggagtcctgttcgggactgattgtttgtgtggacacaaaaattcctcctttaggttatatcgtttctataacgctattatatcgaatttttgattggtagaacaccgatataccaagattttgtgacctatgtacgtgattcagacccggaagtcataattttgtgggaaaacatgctatgatagaacgaaaattaattggaaatgaggattagatatgatcgaaccagtcgataagacgacttttgcgacggtggctgatggtaccgcgttaactgtggttgatttttgggcggattggtgtggcccttgcaagatgcaggaaccagtgcttgaagcgttagatgaactgtacgatgggcaagtgaaatttgcttcgctcgacgttgatcaacatcaggaaattgcgcaacaatttgagattatgagtattccggcgttagtgatattcaagaatggccagcccgctgaaaaggtggttggttttcatccccaagcagcattgaagaaatatctggatcaaaaactagccgaagtgaagcctgcctaacgagcgttatttaacggtagctgttgaagcaatcaataagtccccccagaaacggttaccgcatctgggggacttatttttcttggtgagtaatttacgcgttatgacgtaattgataagctgcccatgtgctgaaaatggcaatgccaagaattgcgaggttaatgagaatcgtttctgtcagtggctgggttgatggggagaaataccattgttctagtaaagaagtgtacaaaaacacgggtgcgtagaagaagcggagccatcgttgctggcggtgtaaccacaccagcgtaattcccgacaaccatatcagtactgatataacaaccgttgtcagtggactaactagcatcgtcagtgtggcgattatggctagcagatagggtgttgtcataagtgggttcttgaatgagttcatcagtagtgcctccttattgaaaaagctaatgctcgtctaagtatatcgcgataatcaaaatgtttgtattgccatcataaaataaaatatttaaatagtgattttgacaataaatcagtttagctgtcaagttagaaatcgttaatagtttaaggggaagcgcaactagaaatggcgagttggtgcgactgccctattaataattaaattattaccggctttgccaatataattagctaagaccatgttaaattaagtagcgtaattatggtaaagtggggggctaatcattgaaaaaattgatttgggcattacgggtcggtatcgtcctctttggtgcttgtttggtgtgggaacaagtgcagcttgaacggcatacaagccagcgccggacctatcatcaacgtcggctgcagcgtagtaccgcagcaacgtttaaggcaatccgtcagccacaacttagtgattttccggcagctaaggtggaagccgcacaagtttggctacacctgaaggggactcgggtcatcaacgaggcaaccccgttacatatccgcaaaattgcggccggacagcgaattcagccagacgatccgcacagcgcggtctatcatcaccaaatgacccagatttatagtgatgatttacaagatgctactaatagtgtgatatacgcgcggaatgcggataatactgtattggttgcgcatagtcgttcggggcaacgctcgcaagtgggtccggttgcccaaaatgttcacacagcaatgccagccgttcaaaagatgaagattccggctaaaccatccgcgacactgcttaaagtcgttcaactgatcatttaatatggggcaatttaaaaggctaacccacacggtgggttagcctttggtgcgtgatgctggccagctaatagtggtcatagagttgctcaattaagtcatcactattggtaatgagctggcgatttagtgaaatcagatagtctggttgtgctgggtgaacggcgttgtagagcgtgtcttcaatgagacagccagtcagcgtgaacgaccgctgccgaccttgaacaatgatggtgaaggaacgtccacgactagttacgatgacattcaatcccattaagtgggttaggttcaaacctaacgttgcagttgaatcaattaatcctggtgtgccagtacgtttaatcaagactaggcattcatcaatccgtcgtagcgaattgaacatcgaaaatttactggtgttgcgcgggtccgatttgacagcccgcggccgccgtacatatggtccaacgactatgttcataatgattcccccaaaccatttagttgattggcttaatcataactagtgcgaacgattagtgcgaaaatttcggcgcgtgttggcagttagttggggcagtttacgggttatctttggaagctttactaacgttgtgacggaaaacatccagtgtatacaaattcgcaattactggacgcaatggcgttcagaccattgatcagtaattgcgaattgcgtaatcgtgatgttaaaaatgaagctaggcttttactttgttgtctgcttttcgtgctttaacggctaattcgggaaaccaaattgcaatttcgtgatgcgcattttcacggctatctgaggtatggataatatttcgtaaaataccgtctggatattcatgagagaaatccccccgaattgtgccaggttgtgcttcggcaggccgggtgctaccagctaaacgatgcaccgctttgacgacgccagtaccacttacgataatggcgacgagtggaccttccatcatgtaggtctcgatttccttaaagtaaggcttaccaaccttctcactgtaatgttgttgaagttgctccgcggttgctttaataacctttaaggcggcaatttgataacccttgcgttctaaccgggtgataacctcaccaatgtgtccttcactgacaccatcgggtttaactaggaccaatgttttttcagaatttgccataatacgtgacctcctcgctttttgaaagcggtatcatttataacttaaattgtaggtgactttgaggggtacgtcaactagaatcgccgttttatcatgaaaattgcttgtaaattggcgtcagctggtcaataattgggacgcgagaagcgggctcaactagctgaattattttctatcgttggaagatatcgctataataaaattagtaaatcataaaaggatttgatactcatgccaccacttgatttaactcatattcgacaacatcatacggttgctgaattaattgcgctaggaaaggcgcggcgccaagtcaccccatttgaaaaattagggacatttacaccggtgaaacgaaacgccagtgattatctgaaacatgtgcgggagatgctggtaccagaactattgccattgcggcgtgaacgaatgtctgcttcggcttttgcattcttccggggatcagttgagttaatggattacgatttggattaccagtcgtccactgaaattcccgccgtagtttgtggcgatgctcatattggtaactttggattctatgcgtcaccagaacggcgactggtatttgacctaaatgactttgacgaagctggcgtccatccgtgggaatgggatttacgtcggttattagttagtgtgttgctagctgctcgtgattctaactttaaaccaaaaaaggtcgaaaaattgatacaggcggcgagtgcgagttatcgggaagcactcaaacggatgtttgatcagacgacgttagaccgtttttatcgcgataacgaagttcaggctgtcttgaacttcggtggtgctcccgaagatacggccgatttaattgcatccttggttaaaaaggctcaaaaacgtaattcagaacaagttgtgcgtaagtttacggtcactaatagtcgcggtgaacagcaatttaaggagaacgcgccccgttctgtccatattgatcggcaaacttatcaagggctaaaggccggaattagcgagtatttattgaacgtacggaccgatgtcgctttgctgttgtcgcaatatgaagttactgatattattcggcatagtgtgggcgtcgggagttttgggtcactatgttacttggttcttctgacgagtacggatggtagccatatggtgttacaaatcaaggaagctttaccaacgcggaaagtcgggagccagtcgcggccagcgttaacggccgccatggaattgacggaagggcaacggatcgtcagttcgcaacgcattttacaagcaacctcggatgcgttcctaggctatttccaaatggaaaataagagtttttatgttcgtcaatttcgggatatgaaggaatccatcgatattccaaccctagactggggtcaattccaagcctatgcaaatacgtgcgcaatgattttggcaaaggctcatgcgcaaagtccaacggcggccatgattcggggatacgttggtaattcggcgaagtttgatgaagccatggctaaatgggccacggcgtatgttgaacaagttgataatgattatcaagatttcttagatgtttgatggtttaaacgaagagttgatcaaatatcgcactgaaacgcgtgacgattagacgtgtattgaaaataaagaaagggtcatcggaatcattgatactccgatgaccttttctgtcggtaattagacatagactaaaatatttttctggagcgtaagtcttgatttaacaacgttttttggcgattgaacaagtgattttgaaaattgataggctaaaatggttgcactttttcaacaacttgatatacttactattagtaagtgaaacgaagaaattagttttgaaaggattgtttgatatgacaaaatatggtgtaattgtaggttctattcgtaaaaattcttattctaaaggggtcgctgaagccatcgttgctgggttaccagacgacgctgaagtaacgtacttaaatatcgctaagttgccactatataaccaagactacgatgcggattcacccgtagaatatacagaatttcgtcaggccgttgcggctcaagatgcgttcatctttgtcacacctgaacataaccgtagtatcccagcagccttgaagaatgctttggacgttgcttcacgtccatggggtcaaagtgtttggggcggcaagcctgctttggttgcttcccaatcgatctctggtatctctggcgtcttagcacaccatgttttacgtcaatccttggtcttcttagacatgccaacgatgcaacaaccagaattgtacatcggtaatactgataagttggctgatgaaaatggtcatatcacaaatgaaggcacccaatcattcttagctggtgctggtaagcaattcagcgaatttgcagcgaagtttgtcaaataattgtggataataaataaattttcaaagtaacgtaaaaacgtacttataaaatcaattttgattttataagtacgttttattgtcgacacaataactgatacgagcaaacggttattctaagccgcagttttgataagaatcaagcttgattgctggttgtttcatgataagcatgcaattgagtggcaactagatgggccgggttaccgaccgcagtaacgtgggcgggaacgttgtctaaaacaatcgcaccagcaccaattttactgttggcgccaatcttaatagggcccaagagttgggcgtgggcaccaatgaaagcaccgcgacaaacatagggatgccggcgcccagcttgttcggttttacgtgcgcctaaagtgacgccgtgtaaaattgtaacgtcgtcttcaatgaccgccgttgcaccaatgacagtaccaataccatggtcaaagaagacccggtgaccaatttgcgcggccgggtgaatcagaatcccggtacgccgggccgcatgttggctcagcaaggcggccaataatggtaaacggtgtgtttcaaaataatgggcaacccggtaccaggcgagcgcgtgaataccaggataggtcaacataactgtccgcaaattgatcgcggcggggtcacgattgagaatggcacgagccgtctgaaacaccagcttaatctgcctgaatgctagcgaacccgcgctcaaggtctgctaacaaatcgtcactggcttcaacaccgactgataagcgaatcagctcgtctttgatgccattctgtagccgaattgtgcgtgggatggcaccgtgagtcattaaggctggaatttcaattaaactttccaatgctccgagactttcggcgagcgtgatgacttgtaaatgttcaacgaaggtctgggggttcattcctggttgtaattcaaacgagatcattgcgccgaagccattcatctgttgcttggcaatcgaaaaatcgggattatcaggatcgcctggatagtaaatcttagcaactgctgggtgagactttaagtaagtaaagattttagcggcattattcaggtgggcttgcatgcgcaatgccagagtcttcataccacgttgtaatagccagctttcttgcggggccaaaatactaccgatggcattttgcaagtagccgattttttcgccaagtgctggcgtcttggtgacaaccaagccaccgataacatcactgtgaccaccgagatacttggaagcactgtgtaaaacaatgtcaacgcctaaatccaggggcttctggacgtatggggaggcgaaggtgttgtcgatgatactcagtaaatcgtgtgcttgcgcgagcttcgcaatggcagcaatatccgtaatgtgtaataacgggttcgtcggtgtttccaaataaatcgccttagttgtgggggtaattgcggcttcaacggcggccaagtcacgcgtatctacggctgtaaaagtcatgccaaagtgtttcaaaacggcgtcgatcaagcggaaggtgccaccgtagacatcatttcccacaataatgtgatcaccagccgagaatagtgagaagacggtattaatggcagcggagccagaagcaaatgcgaagccagcgctgccatgttcgagggtggcaattaatgcttcgacggcggcccgggttggatttcccgtccgtgaatattcgtattgattttgaccgatttttgtttggcggaaggtcgaggccatgtagatgggtaccgaagtcgcgccagtagtggcgtcctcactgataccaccgtgaattaattgggtttcaaatttcattgttaaagtcctcatttcgtatagattttttggctcagataacgctcactactgtctggaaagatggtcacgatatgactattggcaggcaggttggtggcaagttgtaaactagcggctagcgcagcgccgctagaactgccaatcagtaaaccgtggtcacgggctaggtgtcgaacttgggcaaaggcatcattgtccgcgatggtcagtgtctggtcgatgcgaacctgatcgaaaaatggtgggatgaattcgacgccgattccctcggtacgatgtgcgtgagctggtccaccatttaaaatggaaccttctggctcaacgactacggctttggttgctgaatcttgggcttgaagataagccgctactccggcaaatgtcccaccgctaccggctccagcgacgaaggcggttataggtgcaggcatgtccgccagaatttctggtgccagtgtgtggtaataagccgcgggattagccggattcttgaattgcatggggacgtaactgttggaaatcgttgcggctagtgcctcagctttgcgaatggcacctttgattccttcctcgctaggtgtatgaacaatttcagcacccaatgcttgcattaaaacttgtttttccatactgaacttttctgggacgactaagatggtacgtaggtggtgcgcttgagttgctaaggctaaaccaattccggtgttaccagcagttggttcaataatcgttgtcttggcgttaacccggccccgttgcaagccgtcttcaatcagataggctcccagccggtccttaatactgccgccggggttgaacatttcaagcttggcatagatgtgactgtgatttggaacctcgatgggtaacgccatcaggggggtgtggccgataagttcttgaacgtgctgaatgagcatataaattcctccaatcgctgcggtggggtgccaaaagcgacaaaaaaggcgcgagaattcgaatgaattcctcgcgcccagtacaatatccagccatgctggacattgatttttaggatgacactcctcaaaaagtcaatgcttaacaggccgaacatcgcgataagcgcgcagttcggcaacaacagttattcaaagcactacttgttaattgagtcatgtctgatcctcctctggattaattgggactaactatacaagatgattttgagcgcgtcaagtggtgaatgacgatttgcaataagcggtaaaagatgaagattggctgagaacgttattgaatcagcgttagttttgccaaacggttgtcattaaaataaatatattaggtggttgaatcagttgattgtgaccgaggataaagatgttaaaatttatccaatatcagtttttcatgtcttataatcaagacgttttccaagacacatataactagttttattctgacaatagctagtgaacgtgctgttgataataactaaaacaatcccaccctgattagcaagtgactaaactagggtgggattgttcgtgattataatttaaatgatattacttattccataagtatttagcatcaaaatcattatcgaatgatgataaaatcttaggaccgtcatcggtaacgacaagggtgtgttcgtattggcagctaagactgccatctaaagtgcgaacagtccaaccgtcatcggcagtttcgccagaacgccagtcaccaatattgaccattggttcgatagtaatggtcataccagcttttagacgggtgccgtgaccagcttcgccataatgtggaacatcaggcttttcgtgcatcgtcggtccaataccatgaccaatgtattcgcgtacaacgccgtaacccatttcgttttcagcgtaattctgaatagcccagccgatatcaccaattcggttgccaacaacggcttggtcaataccgaggtatagcgctttatgggtcacttccatgagttttttaacttcgggtgatggtgtaccagcaacaaaggcgtggcaagagtcactaaggtagccatggtagttaataacggtatcaacttttaataagtctccatctttgaccaagatatctttactaggacagccgtgacaaatcatgtcattgacgctgacacaagttgagtacttataaccttcaaagttgagttcgccaggagtagcgtcgtgtgcaacgatgtattcgtaggcaaagtggtcaacatcccaagtcgtaattccgggcttgatgtagtcttcaagggcgtgaaacaggccaaccatgatgtcaccggcagcttgcatccctttgatttcgcgatctgatttaagcgtaatcatgaggttcctccaaaaaaattaattatattgtgatgctaaaagtttgttcctctccagtatactgcaagcattgtattgcgacaaaacgcattgttttgacctgatattgacaacgctatcagtaggccgaaatcaaaaaaatataaaaaaatcagcacgccaaaaataccaaattgccggggcgcagttggattaattgtaaacaattcaatataaatttggaattttacccttttcatcggccaagataatgatacaatatattgtgttgtttcaaacggaaacactacatgtagtagtgtgacgtgactggttggccaactagacacctacaaccgcatatgaaaacggaaagaggagcatgattttgagtaattattttaaattcttatcacaccaactaaaaggttggccacaacagaactactatctattctattttagcctaggatgtcaagtaatgacgttagtaagtgcgccaattacagcattgtctattttaacatttattgggaccactttgggtgttctttgtgtgttagccattaatgcggctaagtcagtcaatggattattaggcgtcatctccgccgcttgcttcatcgtagttggtttttcagctaagaactatttaagcattggggaacaattagcctacgtcgtaacgcttgatattccagtactattaagtgctaattggaacgtcaacatggtttcaaagattcggaagtttacgggtaagacgtggatcgtcgcaattgtcgcaactttagttgtttatgccatctccggctatcttattggtgccttaactgatgatccccggccatgggtcgatgccattagttttgcgatttgtttaacggccggcgttatttgcttcctccgttacaacaaccagtatttctggtggattgcctctggtttagcacaaatggtcctctggttcatctcgttccgtcaaggttcggcgacactagcaatgttcattaatagttccgtttatctgatgaacgatgtcttggctttcactgtttcaccttggtataacaaacatgaacgcgctcggttgatggccgaagaacaagcagctagtgatgcagctagcgcggatgctagtgataatcaggcatttggattgaatcactaaaggtcagctaataaatttactgagactagtagcgttaatattctaaataaggcgagtactgtaattcttttggattagagtactcgtctttatttgaatagctccggattgtatcagttatcaaatatatgattttttattgacattataataaacaatgttaaagtttaataaacaatattaaaaaagagggatgctatggactggtttgtgaatttagaacgtgaggatcaggaatttgttaaacaattggttattgcctcaggttctctaaaacaactcgctaagatttatcaagtgagttatccaaccgtgcgaatgcggttaaacacgattattcaaaaaattaactttattgaggacaacggtgcaaatacgtttgaaacgaaggttatgaaattggtaatcgatgagaaattatcgttagaggtagcaaaacagattattactgactttagggaggaacaacatgagtgattttaaaggaattctgattggtatgttggtcgttgcagtgctctatatgttagatcgatacttaccaaggtggtttggggcaattccgggagctggctttttaggctttattatttacattgtttttacaaaagaggtctctttattatcaatagtaaccgtattgttagttggcgaagccgtgctgaatggtatctggatagatgcactcgtgaaccgaaagagaaaaatgaaaaaagaagtagcaacaatgaaagcgaaagatttattgcgaaaatagtaatattaatgaaatcatcagatatagaatcgacattggttggagattgctgttagcgctctgcgaatgtcgattttttattatggtgcggactatcctgctagttcaaccaatactgtataggtgctggcacttattatgaagcagttattgaatactgaaatataagctcggattttgtgaactctagacatgtctagacttgatctggctggtataatctacaaatttaattgggttattacttaaatattgacaacttgtctaaacaagtctatattcataaatgaaaacgataacaaaggggtggttgccgtgaataaagcggccttagtttatcaagatttgctccagaaaattgatgcggaggtttacccgatcgggagttatttgccgagtgaacatcaactttgtgagctatatgggatttcacgtgagactgggcgcaaagcattagcgacattggctgaggatggctatattcaaaaaattcgtggtaaagggtccattgtgattgagcatcgacagtatgaatttccagtttctggcattgtgagttataaagagttagccgaaaagttacacattaagacgcaaaatattgtttatgactatcaaccggatgcaacgttaccggttgctgactttacgtcacttggtaccgaattgacggaagcgccagtgacggccatcaaacgagtccgagtgatcgatggcgaaccagctattattgataaggattatattttgaaatcgatcgttccgaaagttcccaagcaagcggcggaagactcactgtacgcgtattttgaaaatcagcttgggttgacgatcggttacgcgacgaaggaaattacgatggcgccggcaactgatgaggaccgcgaacacctcgctattagtaagggcgcctatgtggcagttgttcgaagcgtgacgagcctcacggatgcgcgagcgttccagtatacggaatcacgacaccgggcggaccgctttagtttccgcgattttgctcggcgaactaagaaataagatctggcatgagagggatagcgcatgaaattatcagaacaagtgatttatcagatttatccgaagtcgttttacgacagcaatggcgatggcgtcggtgatttacgaggtgttattgaaaagatcgactacctcaaaaagttgaatattgacatgatttggtttaatccgttttttgtctcaccacaaaatgataacggttacgatattgcagattactaccatattgaccccatgtttggcacgatggctgattttgaagaactcgttgcaaagctgaaggcaaatggtatcggggtcatgttggatatggttcttaatcatacttcaactgaacacgagtggtttcaaaaggctttggcgggtgatgagaagtatcagaagttttactatctccgtcctcccaaggctgatggtagtctaccgaccaattgggaatctaaatttggtggtccggcctgggcgccgtttggtgatactggtttgtactatttacatttatatgatccgactcaggccgatttggattggcataatccggccgtacgacaagcgtgtgccgccgttgtcaatttctggcggcaaaagggcgtgcagggttttcgtttcgatgtcatcaacgttaccggtaaagctgagaagttggtggacgcacctaagggggtccctagcaagacgttgtatactgacacccccgttgttcatgattatttaaaggaattgaacgcggcaagcttcggccaggatgtagatagcgtcacagtgggggagatgtcttcaacaaccgttgcgaacagtgttggttatactaatccggctaatcacgaactctcaatggtctttaatttccatcatttgaagacggattatgttgatggacggaagtggtcccgaatggccttcgacttcccacgattgaagcaattattagatagttgggccggtggaatggcagctggtggtggctggcaggctttgttttggaataatcatgatcagccacgagcgctgaatcgctttggtgacgccggtcgttatcgtgtcaagtccgctgaaatgctggcgacggtcattcacctcttgcgtgggacaccatttatctatatgggtgaggaactcggcatgactgatccggactatgacaatatggctgattacgtggacattgaggcattaaatgcttatcgggctttaattcgtagtgggtacagtcatcacgatgcgtttacgatcgttaagaccaaggcgcgcgataactcgcggacgccgatgcaatgggatgatagtgccaaggctggtttcactactggtaaaccgtggttgacaccgactaatcaggcgacgattaacgtggcccatgaattggctagtggcgagatttttgactattatcaacggctcattaagctaagaaaaacgatgccgatcgtcgcggatggtggttatcaatcgtggcgcttagatgatccgcaagtcttcggctattggcggacatatcaccaacaaaagttattagtgcttaataatttttatggtcagtcaacaacggtgacacttccggaagaaatggtcggtgcacaggtgttactttccaattatcaagatgttaatgtcacagcacaattgacgatgcaatcctatcaagcggttgcgctgttgttaggttaagaatggaggaatgggtatggcaaaggcacaaacagtaacaattttgtcgccggtcaatggggacgttattgcgttaaataaggttaaagacccggtcttttcagccggtatgatgggactgggctttggcgttcaaccttcaagtggagaagttgttgcaccagtcagtggtcaggtcacgatggtggctgagacgaaacacgcgattgggttcacaacgcctgatgatcatttggaagtattagtgcatctcggaatcgacacggttgacttaaagggtgccccgttcacggtcaaagtggccgcgggcgatgatgttcaggcgggggacgtgattgccaccatggatttagctgctattcaagccgctaatcgtcagaccacagtgattttagcagtgactaacactagtgataaattggaatcgttggacgtcgttacgggggcaaaagctgccggtgacgtgacagctacgggccgtctgaacgccaacacatttaatgctaagcggcagaatcgattaccaaaagcgggtaaatatgatcagttagccgcggacatcgtggctaatgttggtggtgtcgagaatgttagtagtttgattcactgcattactcgcttgcgtttttatttgaaagatgagagtaaagccaatgatgacgtcgtgcgggacttaaaaggggtcatcgacgtagcaaaagcgggcggtcaatatcaggtcgtgattggtcctgctgtcacggatgtctatgatgcgatcatcaagcaaatcggaccgggattttcaaatgattcggagacggctaaagctgttgctgagactgccgcagcagctcagcggccaacgacgccgtggggcaaagttaaatggggtatcagtaatttaattggtgttatcacgggttcaatgattcccgtcattggattattagcagcctctggtattttaaaaggaattcttgcgttacttaccacgtttaatttagttagcccgaccgcaccaacgtacgtgattattaatgcgatgggcgactcggtcttttacttcctgccaatcttcgtcggttttacggctggtaaaaagttaggggcagatccggtgattatgggaatcatcggtggggtgctgacttatccagctattgtaacgatggcaagtggtaaagcgacgagtacgcttttaggaatggggatcaacgcgaacttctttggcttgccggtacacgttgcctcgtatacgtattcaattttcccgatgattgcgggggcctggctagcaagtaagttggaaccatggctaaaacgggtgattccaacggtattacgaatgatttttgtgccattatttgaagttgtgattgtttccggtgcgattctattattccttggtccaattattactgtgctttcaacgggattggcaaatattattgtgtgggtctacaatttgagccctgcgatttctggcttaatcattggtggcttctatcaagtattggtgatcttcgggttgcactgggcggttattccgattgtggccaacgatattgcaacgacgggtcacagttacttgaacgcgattgtttcagcgacgatggttgcccaggggggcgcagtattcgcaatcgccttaaagtcaaagctggctaacattcaagaacttgcttggccagcaacgatttcagccttctgtggtgttaccgaaccagccatgtacgggatcaacttgaaatatggtcgggcctttgtgactgccagtattggggcggcagttggtggcttcttgaccggcttgatgaatgtcaatatgtggggctttacgggttcactgattggcttcacgtcctttgttaatccgaagggcttggactttagtttttatggtttcttgattgcatccgcagccacgattgtcgtgtccttcgctttaacttggatgtttggttttaaggatgaggatgcaaatgcagttaaagtagcgcctaaaaagcgacacttaggtgcaaccgcctagttaatggcgacgtcaaataattaatcaacgttaggataaacaagtatttttccgattcggaaaaatgcttgtttttgatatttagtcgccctaacgaagtgatggtaagtgatggagattggtctaattgtgatgatagaattttaatggatcatgattggacgtgagacggtcgtcttaaggatttttgaaggttaggttaagggttttacatgggggatgatgattatgggaaaaatcgatgaagtagccattttagcaccagttactggtcaagtattgtcattggcaacggttccggatcctgtttttgcggcgggaagggtagggccgggatttggtgttcagccgacagctggtcacatcttggcaccagttagtggtcgaatcacagtagtcgcaacaaccaaacatgcaattggcatggtgactacgactggcctcgaagtgttggtacatctgggtgtcgatacggtggcactcaatggggcaccgtttgaagttcacgtgaaggtcggtgataaggtgacggctggcacactactagtcgacatggatttagctgctatcgagcaggcccacaaaccgaccacggtgatcattgtcgtgacgaacgctcagcgggtactcactgacttgacgctagccccactgccacaagctgtcgcggccggtgcagtcgtcgcaacggctcacttgataacagtgacaaaaaccgcgtcaccggtagtggcagcggtgccgcagtcaacgacgcattactcggcattagccacggcaattgtagccaatgtgggcggccaacaaaatattaatagcgtgattcattgtataacacggttgcgattttatttgaaggatgaagcactagcgcacgatgcggttattgcgaacttggacggcgtcattgatgttgcgaaggccggtggtcagtatcaagttgtgattggtccggcagtcaacgatgtttttgatgcagtgatcgcacaactagggcctgaatttgcggacggagtgccagtaccaccggttcaggaggcatcaagtgacgttaattggctaagccacgtgcgtaatggcattagtggtgtcattggtgttatgaccgcggcaatgattccagtgattggcattttggcaggttcagggattttaaaaggaatcttggccgcgttaacgggcttcaaagtcttggcggtcacgagtgggacgtacatggtattgaacgcggtagctgatgcaacgttttactttttaccagttgtcctaggctttactgctgccaaaaagttaggttcagatccaatcgtgctggcgattgtcggtgctgttcttatctatccaagtctgataacggcagctagtaagggaaccacggcccaaatcacgttcttaggtgttccgacgcatttaatgtcgtattcggcatccgtgttcccgatgattgtggctgcatggctaggcgtgtacgttgagcgggggttaaaacgagttgttccgctgtatttacggagcgtctttattccgattatcgaagccctgattttggcggtagtggtattagtggtggtcggtcccttaattacgattataagtaagggcttggccaacggtttggtcgccgtctataattttagcccggccttatcaggattggttattggcggtttataccagacgatggtcattttcgggctccactggggcattattcccattgtgatcaatgatattgcgacgaatggacacagttatttgaatgcaatcctctcgattaccatggtcgctcagggtggtgcggtgttagccgtcttcttaaagtctaaggataagcacctaaaggagatctcactggcagctgcaatttcagccttttgtggtgttaccgagccggcgctatacggagtcaacttgaaatacaaacgggtctttgtcgttgctagtattgcgagtggtctaggtggcttactgaccggtctgttacgcgttaataactatgctttgtcagggtcgttgatcggtttccccgcgtttatcaccccgggtgtcggcatcgggtcaaacttttatggttatttgatatcccattacgggacactagtgattgcaacgatgttagtttatgtatttggcttttcggataagttgttaggtcctaaggaaaacttaaaagcgactaataatcagtaactaaaataaggctcctgctgaacgtagcgggggtcttatttttatgaactaatcgcttgcaagcgtgcttgttgtcgaatcgcttcaacataaatgcggacaaagtcggtgccatacaggactgctagttgctgttccagatttggtgtgggtggcaacacctttagcaagggtcgaatccattgattggtgggcaatagtcgcaatagatggtggctggtgaactgtgagaataggagattgcggccgaagtattgtccaagatgattttggaaagctggttgcttaactggcaccagttggagactgctgttattcatgttgcctagtaacaatttggcctgaacaaagtcgtcacgaaggtcaaaatgctgattcttgtaggccttagcgatttcaggtgctaattggaccaaccaaatgagctgatgttgttccaaatgcagaatcaagcgcagtgtcataatatcagttgtcgtgagttgataactgtattgttgcagagtggctggtgttaattcttgacgcaaggtccgttgaacggcgtcaaaattaccagcctcccaactaatggttaattgatcatggttcgtcagccatagcaaatgatccgcgatccgcaaggtcaaaaagcgcggggcagccgtccccggcgtctttagcattagtagccagtaagagctggcactagaacgcgcaaaattgcgtgctaagacgtgcgcacaggttggcaaggctaattggacagccaattgtaagcgtcgccggtcagtagcagtattaacaaactggtgtgggtcgtgtgtgattcgtcgttttgccatagacatccctccctcattaatacactaccttaattataggccaaaaaacgtggtgtggcgcattgaatgtttggttttaatgataaatcaaatgttattagagtcgtttgattcgctgatattccagttaagaatattaaccagtcaaaactcgatttgtttcaaccaatcgcgcaggttaagataaagatgaaggcttaattgaatcataatatcattaatctacagaaacggggcgatgttgtcatgaaacgaattgttgtgggaatcacgggagcgtccggtacgatttacgcggtcgacttattagaaaagttacatcagcggccagatgttgaagttcacctggtaatgagtgcgtgggctaaaaaaaacttggagttagagactgattactcgctcgcgcagctgacggcgctcgcggatgctacttatcgggctaatgaccaaggcgcagcgattgccagtggttcgtttttgaatgacggaatggtcattgtcccagctagtatgaagacggtagcggggattgcgtacggcttcggtgataatttaatatcgcgggctgctgatgtcacgattaaagaacaacgtaaacttgtgattgttccacgtgaaacaccgttaagcgtgattcatttagaaaatctaacaaagttggcaaaactcggtgcccaaattattccaccgattcccgctttttataatcatccacagtccattcaggatctggtcaatcatcaaacaatgaaaattttggatgcgtttcatattcataatgaaactgatcgccgttgggagggggattaaacatggcaacttttacgactgagcaggccgggtatcaaatacaagcaacactccaagtgattggatatgacttgttgatcgtcgttaccggtgggaccaatccccatattggtgacgtgaccacactaactgccagcacggttcccgaaacggttaagtttcctagccatgatggtcgcttccataaagataactttatttcggaacgaatggccaagcggattcagcgttatctagatggaagctgtacaattactgcgggaattcatgtcaaccaaattactaaagcacaaatagcagctgcggcaccaatgacggatgacctcagccgccagattattagctggttacaggcccatcccgtccaggctgaaaagccggaatattatggacaagatgagcaaccgcggtagattcgtgacgcatggggtgtcgaaaacagcgcaatattgtctttgcgccctattgctggataatatgcaccgagctggccgtttattgttattaaagttgtactagatgaaataattcaacaaaaaaattgcgcttcagatgttgattctgaagtgcaattttttgtccaagttaggcataaacatactagcatgtttgtatttaaacggagtggcttgcagggtgaattataactttagtatcgacatgcgcgctggcttccgcaatcgcacaccgtcagctaatctggcagcttatttgtgggcatctttctttgcttgttccactaaaatgttatcgaccacgtcttgtaagctagtcttagctaaccgtgcttcggctgccgtttgcgcgtcttgatagtattgtttcagaacggtttgaatattgccaccaacaatacaatccggattggtcttaggatcgacggcgagtagtggcttatcgccttcaattgcgtagaagacgctgagcagtgaaatttgacttaaaggtttggcgagtgccggttgagcagtaccgggcgttgttgtgattagtccggcttgtcgaagcttgctcatcaatcggcgaacaacgactggactagtttcaatgctgcgggcaatggcgtcacttgttaatttagtatctgcgtaaattttaatgtaggccagtaaatggatcgagtcgctaaagcgggttgaaacacgcatataatcacttcctgtaacttaattggttactatgattataaataaatccacttataaaagcaattaacgagtttagtaaagctaatgatgtaacttttataaagatggttgttttgggggaccgaatcagttatgatgtaaatgccaaaattgagcagttactgcaaaaaaggagcttatcatcatgagtgaaattgaaaccatccaggcctattatgcggcttcattggggaaggatggtcgtattacccggacccaacggcaaattttagccgccgcgctcgacttatttgcagaaaaaggttatgaagaagttggcactcgggagattgcagagcgggccggtgtcgctgaaggaactttatttcataattttgttaataagaacggtattctggacgccattatgcagccgattgtgcagaatattttgccaacgatgttgaacactttggaccaggcaattttagatagtcctaaccagactttgcaagcatttgttgtcgcccttgtgcgcgatcgggtcgcatttgtcacacgtaaccgagcctccttagccgtcattttgtcccaatttttcaataatgctcaggatcgagcggccgtcttagggatggtctcacctagcattttggcgcaggcgaatgaagcgatggatcgcttgaaagccgctcgagaattagttgattggccgaatcgcatgattttacaattggtgttttcaaccattgggggatatttagtcgaacaggttctctacccacaactggatgatttgagtgatgagcaattgattcactatctcagtgattttttagttaatggtttgagcccacggagaatccccttacaagatgataataccgcgtcataacaagctttagggatgccaaagtaataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaactttaattgcctacactggaccgggtgcactagttgcagttgggtacatggatcctgggaactggatcacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggtttccggaaaatcgaagcaattgtggcaacgctggttgccgtgattctcttcgtcttcctgtatgaagttattatttcacaacctaatattccagaaatgttaaaagggtatgtcccaactagtcggattgtcagcaaccgttctatgctattcctagcactcggaattgttggggcaaccgttatgccgcataacttgtacttgggatcatcaatctcacaaacacgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggggatcttggccggttcgttgacttgtacaatgcacttggcgatagtaaggtcgttggctcgattgcgagtccgttactcagtatgctctttgccattgcgctgttgtcttctggtcaaagttctacgattacggggacgttatctggtcagattatcatggaagggtttatccgtttgaagatgccactctgggcacaacggttactaactcggttaatctcggttacaccagtgttggcttttgcgatttattatcatggcaatgaagcgaaaattgaagatctgctgacgatgtcgcaagtcttcctgagtatcgcgttaccatttgccatgattccgctagtcatgttcacgagtaatcgggcgctgatggggaacttcaccaaccgtgtctgggttaagtggacggcttggatcgtgacggtgattctaatcatcttaaacatttaccttattttacagactatcggtctggttaaataatcaaacattaaaatgagctttccagggattgcaaagaattcctggaaagctcattttgtgttttgggaacagctgcaatgcaagataccgattcaaagcgccaagtgctaatacgtaccagtaattggcgattaaccgactttggatggccagtcttgcttagttggtatgatggtaaacggggtcgcagtgatgaggtccgtgaggcaggggagcaatccggtctcaaggttatataaatcgtgaacgtgtgcgctagtttgaccgtgctcagccatcttaagtagttgaggctgggtgaactggagttgactggctggtagaatcaggtccggttggctgcggcgtgtcaacggttgggcgtggtcgtgaaccaggtaagcaaaattaggcgccgtattgagaattagcgttaaaacgctgatttcatggggatctaatttggttgctaactggttcgtttgactaggggaataaaccatggcggcgtagatttgaggcgccagctcgggtaattggcggctaggcggtgtcagggtgaccgtcagtcccaattgccagctggcgagcaacaatcccggaatcgttacgacttgtgcggggctcagtagaatggcttgtccggcatgcacgttctgttgttgcagactagtttcacacagtgcgaggtcttctaaaacatcggccccggtataccagttgccatttagatctttcagaactggttcggcatattgacgttgtaattggcgggtaatggccttagtcagctgactcatcgcggggcctcctttaagggtttaagtgacggggcggaaattaagggtggcagtactactttgcgttagtgagatacttcatcttagtgatactctggctactagcgtcaatggttgctaacacttgattttgggtggatttaacgacaagcttagttggctgtggtgttaaatcatgtttcggctggtgggtcgtggtacccgttgcgagtttagtatcacgagtaactttgttgacgagtgtggtggatgtcacttcaggatttgttgtcgtcgtgtcagcagaggcggaaacggaagtcgcaaagagggttccggcagccattagagtaagggttagttttttgaatgtgtttttcataataatcgaactccttttagttgttattattagtgaatgattattgggcagctggcattaaccagtcgttagagagtagttgatggaagtgacgaccaagtgggacccataattgcgaacggcggatgttttttaacgtgtcccagaataatggatcttgtagttgttcatcactaagtttgactttaacgaattcgccctcttcagttttcgcaatcaccagtgggtaggtcaccttaaccaattgaacggcggtgatatttttaatttttggatcagtatctaataacatatctacatagctccttagttgttgtgagtcattctatttttatgagttaatttttaaagttggtttgtttaattgaatgactatagtttaccggcatatcgccgtgggaactatcgactttccataaactttatctaagaaattcttagattcagacttagaatataaaaaataccatgaaaattgaatctgagcaggtaatactttggcaggatcaagtactagttaaattaacaaccgtttcaagactgttaatgtccttaaaacggttgttaagagtttatttgtaaatgaattagcttagtgtgcagggcggttaataatactaatggcaaagcctaataaagcacaaataagagaaacactaaaggaccaggttaaaccatgggcaaaccaagcaggatgtgctggcaagtaagtactaactcgatatccagcatcgatgctcattgttgtaaatagtgcaagagaaccaagtgcgacgcctaaaatattgccaatattatttcccaaagactgtagagaacccgctactcctagctgattttgtgggacgactgacattagtaatgtgttatttggtgcaatgaaaaatccagtgccgataccgttggaaattaacaaagaaataatgagggttaatgaagtatgtgaatctaggaataagaagccaatttgcgtaattataattaggactaggccggttagtagaacaagctgttgagagaaaagatcactcaaccagccaccaagtggggcagcaatagccataataagtggaaaaatcagcattaatattccagtagtaccaactgaccagttcaaataatcttggagatagagtgggaatataaagctgaacagtgcattaataagtggtatcagcattccgactagcaatgctaagctgaaggtacgattcttaaaaatggatagtggtaatagcgcattttttcgatgcttttccaaataaataaagtatagtgtaagtgctaatgtgataatgaagccaatgataattagcggctgcctgaaaccaatagtctgccctgcttctaatacaacaaagaatagtgtgatgataatgaatagaatccctgcgccccaaccatcaagtttagtggcttgttgccggccatgatttttgggaagaaataggtggcctaaaataatggcaatgattccaagtggaatgttaatcataaaaatagcattccaagcaaactgctgtagtaaaaagccacctaaggcaggtccggcaacaaaaccagcggaaataaacattgtattgatacccatggcagttccccgggtgtgattatcaaacagttccgaaattaaaccatagctgtttgaaagcgttgcggcagcgccaactgcttgcacaaaacgagccaatagtagaaactcaaagccgaagttgacactggccattagtgagccgatagtaaagctatacatacctaaagtaaagattctacctttaccccaaatatcaccaagtttaccgaatgttaccagtaagcctgatagaatgaccatataacccatcacggtatatgtgatctgactaattggaaccgcaagtgattttgacatgataggtagtgcgatattaatgattgatgcatcgagattagccataattgtaaaaataccgatgacaatcattgctaaccaagaacgagttgttgttttcatgataaaaattcaacctcctattttttgaacatttgaaagtataacaagttcgtgttacactaacgcaagcaaaatttaggaggatacgagtatgtttacaattacggcgaccgctcagaaatatggtgtgtcgaataatgcactacgttactatgaaagtgttggtctaattggcccgattaagcgtgatcaaaatggtatccgacaattttcggctagtgatcaagagatggttaaccgaattgtacatctccggcaattaggcgcgtcaattaaagagattcagcaatacagtttccgtcctgaagaagtaacactagaacgtacagttgcactaaaaaaatttctgttacgtttaaacggagatctagaagcacaagaggcgcaaattaaaatagaaaaacaatatttaaaagcaaaaatagaacatttggatggtgatattttgagtatgaaatctcataaaaccacgcagatgggttagtagtaattagtttctgaatatcaattcagaatagtcttggaggtatctttgtgattgggtggcacaagaccaaaagcgagtcctagatttttctagtgactcgcttttttatgagagtaattattagaaaataaaataatagtacttgttactatagttgccagctgaccgtaaagatactcccggatggctggttgtcggtaattttaatgttggcctgattcaatgtgactaactgttgaacgattgctaagcctaggccactgccttcgattgcttgtgaccgagattggtcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaagaccacaacgatttgttgtaacatttccgcattaccttgaacgtggatgttcggatcaattgcgagcgtcaatggttgatcaattgatggctggtaatgttcagccagtgacaacattaatagtgataggtcttggtcagttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgcgaagcatcagaaataaattgacgctcatgctgcaatcgttgattttgcgtgaccaacagttcattaaaggcccgaccgaggtcgttgatctcgcgggggctagcaggcacgtctaaggtgggctggtcgctatccggattgttcgatgtgtacttggttgcgtgtaacagtttaatggttgggtcactcagtcgcagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcttagtctgttgcttggtgaaaaacgatttggacgatggggtagtgatgatcgtccgcttcgttttagtggcggtcgtcaaggttgctttcttggtggttacccggataaatgccggttgtttcgtattgcgtgtcgtcgtattgttccattgaataaaactggggacgtctttgatattcgcctggttaagactgctcatcaagtcacgggcttccctagtcgtattgatcgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcaccgtttgaatgagtggggaggcgccggttgtcgtgattttattacgtaaataaccgacataaacgtcaacgacattttgctgaccgagaaagtcggcgccccagacttggtcaagcaagtcatcacgggtaaagacttcgtcgggatgagcgaggaagaattgcagcaaatcatattcacggtgagttaaggtaacttcttcctgcccgttagtaacgcggtgagctttagtatctagctggacatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccatcaagttttggcaacatccagtctagcaggatgaggagcaactcgttttgatgcgcttggtaggtttccatagctgccaaaccgtcagccgctaccaaaacgttgaaatcctcaaattgtagttctttagtcaagtaaccagataggctaccttcatcctcaacaattaaaatcgtttttttcaatgttatgctcctctcaataaccctggtttatgtctaattatagcgaataattatgacgcttttccgatattttgacttatttttatggatttgtgtgaactaaatgaaagcgtcaccggacttatgctaaaattggactatgaaaatggaaggtaagtgagtgacatgggactttttcgtgacgccatgcaggcactgtatcacagtggtcattatggttacaacatcaatgtaaagaagtcggctcccgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcaggatcttgagatcaaaccgcagatcgatggtcggtggggcgatcaataagcggaatttgttcccataaattctaatggtcatattaatttaatgatagaccaattaatcaatagtgacggggtgagtcaatgttttcgtacgatcaggtccagcagttaaaccgcttggaaattgaaatttataagtatattgtgggtcatcccgctgaagtaagtactatgacgattcgacaattggccgaccatagtcacgtctcagcaacgactattttgcgttttctaaagcacatgggctatgatggctacgcagaatttaagttcacattaaaagaacagttacggcaagatgccacacaaccgttagctcagacagttgtaccgatgcggacgttttttgaccgcatgaacttacccgatatcacggctaaacttcatcgggtcgcagaactggttcatcaagctcgaatggtcgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccgtcgtttattatctggaacaattagctatgattattcagccattaacgtaaaggtaattcaaaccaatctttggaacatgttctaaaaatagaacaaattccgatggatggaacaacacccattttagagtgaaagggtatacattttgagaatgacaggtataatgaattttgtaggaagcgtattcatgggtacaaatgtcagatgacaggactactttgtaacggacgaactcaattttatgtaaacggttaactattgattgaccgttagcttacttaaattattctgattgtttgagaatgttcgttaaatgaatatgcacaacaaattattttagggggtcacgacatgagcgaaaacaataacaagtcgagctttgttaatgaccgacttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacgatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggtttcgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaatgcggaagcgcttaaggctggtaaggctttaccaaacgttgtgacacaacaattcttcgacaactttgtccacatgggtggttccggtgcgaccttgggactggctttcatgattgcctttgttgccaagagtgccgaattcaagacattaggtaagctggttatcggacccgcattgttcaatatcaatgaaccaattgtcttcgggttgccaatcgttatgaactatcggattgccgttccgtttatcttggcaccgttagttaatgttacgacgacttacattgcaatgtcgacgggcttagttgcaaagacggttggggtcatggttccttggacgacgccgccaattatctctggttacttagcaacgatgcacatctcaggtgcggtattacaaattgttaatattgtgcttgatggtgccatctactacttcttcttcaaggccttagatcgtgataaggttaaggaagaaaagacctttgctgctaaagaagctgctggcgaaacggtcgaagcttaagttaaatcattaatgtagtaatcgtataaataccaccattagcgacttgctgaaagtctgttgatggtggtgttttaatgtcgatttttgagaagcgcgtgcagattaaagcgaaccgagtgacttggaattgtcaccgggttcgccttttattaacgggtatgaaattgtgggtgcaacattcgggggtgaccatggtcagtacccttgtactgcaatagccaataagcgttttgcggcaaagcgctacgggcaatgacgtgtgcaacggtgtagcgaatcgtgtcggcattagcgtcagtccataaacgccaagttggtaacttagctgcttgaaccggttcccaatcgcccaattcttgttcactagtagttagtgcggtgagtaaatcaggccgttcggaaccagtcagttcgatgtagtagcaatacgcttgcggatgcagggtgttgggctggctcatgatgagattgctcctttggatggttttaacgagttatcgttgacttaaataaccttatcatcaatcatagtacaaccgtttgactaaattgactagctttttcgcttactgttattaaaatgtaatattcaaacttgcaattaaaaataattgagtgttgcgccttgacctggaacgcgtttcagcacgtatattaagtggtgaaaataacgagggggtgcagcacgaatggaaacgggaattttaaaacagattgatttaacaacgacaacggaacggtatttcttcgtgcaagtacaacgactggccgactatgtctggattcgctcagttcaaaactttaagcctttagaattaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaagcagtaactgtgatactttaggcaatcaacaaccaataatactaatggcagcaatcaattttaactaggttaggactaaatcaggcgcgccactgaaggctatactgcttcagtggcacgcctgattatcattaaaagatcacttggtattatcactgtaagtgattttatctaaaccttgggtatcataattgagattggttttgccgtcatacacggtattcttggcatttagcttggtttccatgttggtaagggtctcagtactgagccccagttgggtccgaaggcggtccgacgtttgttgcaaggcctttgtacttaaaatctgataggaactcgtattgatccaagcgggtgagccaatgacttgagtcgactggatgtgtttcatattggcacgatcatgcgtcgctaacccaacaaggtcgttaaagctaaggtcagtttgtaaattacccttcagtgaagtgagtaattgattgtagcgactataggtcttagtctcggcgagtttggcgagaaccgcccgcatgacttgttgttgccgtaattgacggccgtagtcgccccgggggtcctgataacgcatccgtgtataagatagcgcctgtttaccattgagatggtgtttgcccttggttactgtgatgtggtcgaatgaaacgttgagtggactagtgatcgtcacgcctccaacggcatccacgatttgtttgagaccgcccatattgatagttgcatagtaatcgataggcacgttgaatagcttgctaacactagccttggccatcttggagccaccaatactgtaagcggcgttgagtttttgaacatttgtgtcctgatcaccgaccatttctgctaatgaatcgcgtggaatgctggtaatgagcgttttcttggtctgcggattgatcgtaacgaccataatggtgtcagaatttcccttatcaatacgaccgtctgccccggtgtcaacacctagtagtaagatgctgagtggcttagtcgtatcgattttagtactgctgtttcccgtatagatcgtcgattggtagcgcgcctgtgcctggcgaataattaagccaatcgctacgaatgcgataacgataatgatgccgaccgcaattaacactggccgtaattttgaagatgctgaatgccgcatgttcaaatcctcccttaattaaaggcgttaagatggttcccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtcacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgttgaagcacatacgaccaaggacattcaaggaacgttgaaaacggcccgtaaataccacatcgcagtgattccccaagaccaaacaacgagcactgttatcggtgcggacgggttaacggacagtctgattctttcaaccgccaagatgaaccgaatcatcgaaattagcaaggctgattccatcgccgtggttgaacccggcgtcgttaacggtgatctggataaagaagcacgcaagcagggtatgttctacgcgccggaccctggttctaagcccatctctgggattggcggtaatgtggcgacaaacgctggcgggatgagtacggtcaagtatggggctactaaggacaatgtcttaggcgttaaggtcgttttagccgatggtcgcgaagttaagttaggcggtcggacgctaaagcaggcctttggttatgatttaacgcaattgatgattggctcggaaggcacgttaggaatcattaccgaagtaatcgttaaactgttgccgattccgctagggacccccgtgatgggcgtcgcctttttcgataatatgacggccttggctaaagcagtcacggcgattcgaatctccggtgtttatccaacgatgctagaggcattggatggcaatacggttgcggcactcgatcgatacgagaagacgcactatgctaagaatagtgcggcgatgttgatttttaagcttgataatggtggtcaggatagcatggcagtcgttaagaagatactggccgaacagcaagccaacgatgttaagattacgaccgagcctaaggaacaggcagcgctagaacaattacggcgcgatatgctgccggcagtttttgctggtcagaatcatattatggaagatatggccgtgccattatcgcaattagccccattaatggactatattcaagaactatccaagcggttagacgtcgaaatctatacggctggacatgctggcgatggtaatgtgcacccgaccttagtgtggccaacgtcggtaaccgaagtgcctgaaaaaatcattattgcgctacaagaaatgtttaagaagacgctggcacttggtgggacgatttcgggtgaacacgcagtcggaatgttgaaaaatcaatggaacaatgccgaattaggcgaagatgttgatatgttgcaaaatcagatcaaagcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaatgagttgttggttaatgagtcactaagaatgtgcagtgtggattaaccgatgcgaaggaggccccaagtgatacctaagagtgcacgaatccgaattgaatttgatgccgaagtactccgcaacgagatttttgatgtgcatgatttcgccagttttcaaagcttctggcagcgatttgagaatttcttggccgatcgcatggtcgttggtcacctgaacgtgttagagggccgcggcctgattcctagtgattttgcagatgttgacggacacttagcttaccaagttggtgaagatgcgcaccaaattgcgtatgaccaaattgcgcgtgagtggaccatcacgatccgttaaggtagattgagagagaatagagtcttatattggagcgatattgattgagcacaacaaattcccaagcaagtgcagataatgatcagcttttgccagcacccccggaacttttgcaagctgttgatcagttgaaagcttattcgttacgttatgaagttgcgatgaagctcgttttagataagttagattatattagtcgagagtatgagcttcgttacggctacgcgttaattgatagcaagcagtcccggatcaagtcgcctgagagcattgttggtaagatgcaacgtaagcatttaccgttaacgttaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccggtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattattagcaggtaattgctaataatcgggcattttggggttttcttgacgcgaatcaagtccatccatgcacatgactggtatcttatatagaagaaagtaattaagaagttagattgcttttgcaattaaagggttcatgttacttttaatatgcaagataatttccaaggcatattgataataattaatttaatgggaatagctagattaattaaactaacaatcgaatagtggggttaaattcagtgttcagccaaatctttgactggttttcctcggtaccaccagtcgttgataaaactggccagttcttccggtgattcatgtagtcctgtttttaaccaataacggacaacaccaacgataccattgagataatactcaaacatgtactctttttcgcgattgccaataccagtgatctcagcttggttatgtgctaagatctcacgcttagttgttgcgataaagctcatcagaaaatcctggtcggttgttaagatgaaggaagtaacggcgtggcgtttcttaaccacctcaaaaattcccgtcagaatggcttgtaaagagtcgggattaagatgtttatcaataacagctagcagttcttccgtggcatcttgttccatcttctgcatgcaatctttgacgtcttcataatgggcgtaaaaggtgccccggttgatatctgcggccttgcagacagcagtgaccgtaatctcatctagtgactgatgttggagtaagttgattagactatcttgaattaggcgttcggtcatttgcgaacgacggttgtttttagtacctaccactgaagttcacctcattatttgaacaatatactattgtttgtttatttaatgacgattttatgaaaattgttggttgaaattacaccggttttcatttaacatgttgttattatttaaacacattgttgattaaatgtcacgatgtcgttttaagaatctgaattagggaagggatataacgtgaaagggagccgtagacgttttacaatccaagcgattgtttggctagttgtgatggtagcggccatcatcttcctgccaaatatcagcagtctggtacgtgataagggccagaccaagttgccaagtagtgccaagagtcaagtcgcacaagtcattcagaatcattgggggcgtaatcaaaataatacgcgccaagtggtggtggtcttcaataatggtgattcaccgttaacgagtgaccagaagcaagcaatcgatgggacgattcaacgcttcaaagtgcagaaatcaaaatatcacgtgaaatcaatgacggctgccagtgataatgctgctgccaaaaagcaattgatttcaaaagacaaatccacccaattactacaattaatggttggtaagaaccagaccgtcgcgaacatgaccaagaatattacggccggtgctaaaacggctggggttaagacgtacgtgacggggagtgacatcttaaatgatgacttcactcaggaaacggaagcagggattcagaagactgaaattattaccgttattttcattttcatcgtgttaacgttagtcttccgctcgccgattacaccgttagtttcactgttgtcagttggggtgtcgttcattatctcgctgagcgttgtgatgaacctcgttaataaatttaactttccattgtcgaactttacccaagtctttatggtcgtggtcttgttcgggattgggaccgactacaatattctactgttcgatcaattcaaagaagaactcagtcatggcgatagtccggtcgccgcgactgggcgcgcgttaaagattgccggacgaacgattctatacagtggatcgtcactattgattgggtttagtgccctcgggttagcgaacttctcaatttacaagtcagcggttggggttgccattgcggttgctatcctattgctcgtcttgttaacgttgaacccattcttcatggcgttattaggaccacggttattctggccaacgaagaagtttgctggtggtagtacgagcaagatgtggcacggcattgcagcgtcatcagttcgttacccaatcatcgccctggtcgttgttttaggggtttcattgccatttatcttaacgtataacaatgagttgaactatgatacgttggctgaattaaacgacacgattccagcgaagaagggcttccaagttgttcaggatcacttctccaaagggacggctgaaccgtcaacgttatatatcaagacggatcatgccttaaacaatgaaaaagatctaaaagtcatcgacagcttaacgaaacagttacaaaaagttaagggtgttaaaaccgtggcgtctgtcacccaacccggtggctcacaaatcgatcaattatacgttggcaaccaattaggcaccgtcactagtggaatgaagtctgctagcaaagggctaactaagattggtagcgggttagatagtgccaatagtaaattgaagagtgccgatatggatggtagcgcgaagtcggctaagaagttagctgatggggcggatgaagtttcatcaggactcaatactttaaatggtaagactggaaccctttcaagtggggctagtcagttggcaagtggttcgagctcgttagcgagtggattagttacttatactaatggtgtctacacggtcaataatggtttgaaccagttgaacagtaagactggaacgttggctagtggagttaatcagttgactacaggtgccaatagtctgtttagtgggacgagtactttgagttctgggttagataccctgaatgggtataaaacaaagatctctagtggaactggaactttaacttctggagtttcacaactgcaaactggtgcatctgcgttaacagccggtcttcaaaaaatgcagaccagtgttaactctagtgtctcagatgcgacaagtactgctaatacacaaaaattaaatgatttacaaaaaggtttagagcaattaaatgaggcaatgaaaccgttgctgtctactagctcgacttcgctaccagatattagtggaatgacaacaactgcttcgactctggcggacaacagtaatgctgttcaaaacgatgcagctaatttaaaaacagctctgggtgaattgcaaaattctgcatctggagtaagctccgttagcttaagtgatagtgatattcaaacaatagttgatgcagtcaataagaacggtgggacggcattaacaacacagcaaactgctgcattaactgctgcgttaactgctgccggcaaacaaattagtcaaaaggttgagagcgcaagttcttcgatgtcgtcaagtattagctcaacccagacaagcgcacagcagttgcaaacagatctagcagcaatgagtaagacaggtgaaaccttaactaaggagttggatacactctcgacattgagtagtgaattgaagcagctatctaacttgcaacaattagctaaaaaatcaacggaggctaataatggttctttggaagttatctcaaagctgcaatctgcgattagtgggatgcaacagattcaatctggcttaaacggtaccaatggattggtagatggctctcaacaaattactactggcttgaaccagcttcaaagtggggcaagttccttagcatcacaattaaatacgtataccgatggcgtctcaacagctgcgactggtgcaactaaagtcaatagcggtgcatcacaagtgtcaactggtttgacaagcttacaagggcaaattccaacgctaacgagtgccatcagtgcgcttgattctgggactaaccaattagctgccaactcttcaacgttaaatagtggtgcttcacaattagccagtgggactgcaagtttgaactcgcaagtaccaaccttggtaagtggtgtaagtaagcttaacagtggtgcctcgcaagtggcctctggtaacgaacaaatgtacaccagtatccagagcttagtgggtcagatgaagacgctccaagatggtttgaagaccgccagtgacgggactaagacaatcaacaagggtgttggctcagctaacagttacttgactggtttgaagaattctgcagcttctaagacgtattacgtgccaaagagcactttgaagggtaagacttacaagtctgctttgaaggcttatatgtctggtaacaaccacgcaacgaagttaacaatcgtcttgaatgaaaatccaagttcgaagtcagcgatggataaagtaacggcaattcaaaagcaagcgacgaatagcttgaagggaactgcgttagatggtgccaccattgcgattggtggtcaaacgtctgaaacgaacgatacccaagcaattgcttctagtgacttcgttcggaccgctgcaattatgttggtcggaatcctgattgccttgatggttatcacgcgttctgtcttacaaccgttctacatcttagggactttgttattggcttacattatgtccttgagtattacacggatcttgagcaactggttcttgggtcaaagcatgttaacttggaacacaccgttcttcgggttcatcatgttgattgcgcttggggtcgactacagtatcttcttgatgatgaagtatcgtgaatttgataattcggctgcgacaccaagtactcgaattgtcagagcttccgccgtcattggggccgtggtcttatccgctgccttgatcttgagtgggacgttcgccgccttgatgccatccggtgtcttgacgttgattcaagtggcgatggttgtgattatcgggttgattatcctggtattcgccatcccaacgattattccaagtttgattcgcttaacttatccgttgacggatcgtatggaagacgaaaccactgctgaaaagcagacgaaacgaaatcgtcaataaaataagtcagttatgcgataataagtgtaaccaactggcgccgtctaacgattcaagttggacggcgcttttttaaggggctgcacttagattttaaaaccagtgttagttttagtctgggagtatgcggcgagtatgagatagccgggttgaatagcagcaataaggagatggttttaatgcaacgatgtgcatgggcggattcatcaccagcaatgcaagcgtatcatgacaacgaatgggggcggccgcaacataatcagcaacgactttttgaactgttgtgcttggagacttatcaagcaggactgagctggcagaccgtcctgaataagcgggcggcttttaatgaagattttgcggattacgatgttgaccaggtggccgctatgacgaccgccgatgttgagcgactactaaccgatgctcgaattattcggcatcgccagaagttaatggcaacgatcaacaatgctcgtgtgatccgagattggccggccggggaagattttgccacttggttatgggcgtttgttgataaccagcctatacgccaggcgtggacgtcaatcgatgaggttccggcaacaaacgacttggcgcaacaagtgtctaaagagatgaaacgccgcggcttcaagtttgtcgggccgacaaccatttattcttatcttcaagcgactggtctcattaatgatcatgtggcggactgcccatttgctccagaaaatttaccggcctaacgcgcttaattcccggcgcggtgagtaagtgagccgtcaatttaaaaccagcgcgatgacaactgtcaggcgctggtttttattaaaatcaatatgttttggtataagtgcgattgcttaaattttatgtataaataaatacttattataaccataaaaatcattgacatgatgtcgcttaatttgctaagatacggcgtaagaatagctgcggaaggcaagtgatgggagcgacgttaggtgaaagaagtaaggttttggggactcttgttaggactgtttgtctgtttaggggcagtgataccgttagttagtaaggctgacgtacttgatacggcacccgctggactgaatctggaaggcttatttgaaccgggaaagtttgaccgtaattcggccacaatgcagactgtttcaaagaatggccattcgcagcatgttatcgaattaacaaatgacgataatcaagttggggcaatgtggtcgacccctgttaatcgctttaacatgcggatcgataaccaagtctcaatgtgggtgaactttggggacaaagccgtgagtgaaggactggccgttgttttacagaatgatccccgcaaaatgagtgcgattagtcggtatggaaagaaaagcattattggtgagaacttgggtgtttatgggacggatacctatacacggcgaacggcgccggccacgattgctaagacggcgattcaaaaaagttgggcgttggagctggataccaaagtgaatgacggtggtttttgggggttgtatccccgggggaattctttcgatgaaaagcctaaaaaaatgcatatggccgcgagctaccctgcaagtccggatacttatacgcaacggggtggtttaacgtcctcttatcgttttgaacagaaccatgggagtatcgctgataaattaccactcgcggacggtaactggcaccatcttgtattgaagtgggtcgccagtaaacaaatcatgagctataccctggatcagggaccaacacgaatgaccacaattgatacgacagtttttggaaaggatatccggaatgttacttggggattaactagtacggcgacaaccgctaatgccagaacactagtcgtctttgaccggttgccacaaccgattgaaatcgagtcagatttaaacgtaaccaatctgactcaagagcgaactgtccatgaaggagactgggttcatggtggggatgagttggaatatgagtacgttctgagttatctcaatggtgacaatgaatggcaacaggttaaggccagcctaccattacccgaacaagttcactttagtcacgcgaagatccgctatgcggatggtaccgaggaagagatcaatttaccagcggacgataacgaatcgtcggtggcccgcttacaacacgatttgcagcggacactatcaatgaaaaatccgcacgcttatattacgctgattggtgaggctgccaaggtcgatcgggatacttttgttgatgatgacatgagttactttgagggtcacgagatgaagaccgcaacggccacaccgcacttcaccattacgaccaataagaccgttaacctgacgattgaaccgttgacacaagtgaagaaaggcgagcccgtcatcattaagggccaaattaggctaaatgatgggttagactttgacaatgatggcatgcgtatcgagtaccgggtcaatggtgaagcgggagaagactatcagttgagcatggacgatccggttggatatgtcgaatttgaagtggatgccgaagaactacaaatcggtgaaaatcagattacgttacgggctcatagcaaagataacgcctactcagaaccagtgacagtaacggtcacggtcattggtggggagttacagctgaaaaaagtcagtactgaaagtgtgtttgcaccaatcaagttgacgggaacggctcaagtcagtcggcccgagggacttgaagtagttgtcaatgatgatacgggctcgaaagccgcttggcgcttagaggcgaccgcgacccctctcgtgactaatcagggccgcacactagcgggaaacttgtattatcaggatggggccaagctgacaatgttgggaaaggatgccgtggaaatcgcgcgccaaaagacggccccggggatcgactatgacgtgaccgcccactggtcatcgcaacaaggtttggtgctcaaaacaacgcccgccgctgttcctggaagttatcagggtacgatcacgtggcacttaagtaccgtaccggaagcgtgagtttacgattgtgtaagtaactcatttaatcaataagttcagtagtcgcgacaagaattaattgttaattcttgtcgcgactatttggcgttcagcgaaagtgctgactaacgcatttaaacgggcctccgatacggtgcaatgctagtagtagcaagcacaaccagcctttcaggggcttagctagcaaattgaaaaatcttcggtttcagacccataaataaacccagcaagttcacaaattagtcagatttcccgtgtaggttaaaagcagtgcaaagcaattgtcataccaatactttatctgaaggagggtttaagcgtgaatttttttaaacgcgcatggctcaatctaacggcaaaaaaaggccgttcaattctattagtgcttgttacatcagcaatcatgctgtttgtattggccgggttattgattaggaatgctgccgatacggcaactagtaatgccaagaaaagtgtcggggcgaccgtcactttatctgctaaccgggaggcggcttttaagaagatgcgcagcgccacgtcgacgacatcacccgttaaactgagtgatgcgaagaaaatcgccaagcttagcaacgtttcaagttacaatgcgaccgtctcaacttccgctaatgcgaagggctttgatacgatttcaacatcaggtagtagtaccggtggtgggatgaaaggtatgggtggctcaagtagcagtggtactggtgatatctcgattactggggtcactaatacgaacagcgtctcaacctttgaaagtagctcaagtaaaattacgaagggccgcggtattacagctagtgatgaaggcactaacaacgttgtcatcgaaagtgaattggctaaggaagatagcctgagcgtcggtgatacgattaagttaaaagcaacgaccggtgataagaagacttacacgatgaagatcgttgggatctataaagcgtcatctagtgcaagtacgcaacaaggtcctggtagtaccgatgtcagcaacagtgtttacacgtcatacacgttcgctaacacggtcaagggttctaagtacaagaacacagctgattctgtgacttttgcaatctcagaccccgctaaagttagcagcgtcaaaacgtctggtaaacagttgatcaatacatcgaagtattcgttgtcaacggatgatagcagttaccaaacggttaagagttcgatgaataacgttaaatcatttgcggataagattgtctggctcgttgcgattgctggaacgattatcttagctttaatcgttatcttgatgattcgtgaacgccgctatgaaattggtgtcttgttatcattaggtgagagccgttggaagattgtcgctcaattctttgctgaaatggtgatggtcttgatcgtctcagttgtcttagccggattcggtggtaagtttgttggtaataagctgggtgaccagttagtttcacaacaaacgacgactgcaacgactacgacgagttcaactagtcagcagggtcagcctggtggcggtggcggcgcccctagtggtaacactggtggtagcaagctaagcggcaatatgcctagtggtggcggtcagactggtaatgccagtgccacgaccgacacgaacttagatattaatgtcacggtaatggatttagttgaactcggcggctttggcttagccatcatgttcctgtcgattatgctggcttctggtggcatactacgactacagccgaagaaagttttaattgattaggaggggcggcaatgttaaaagtaaatgatcttggttactggtatgaccgccaagaaaatagtctatttgagaatgtaaaccttgaatttaagtcggggacttcgtatgccattgttggtcaaagtggttccggtaagacgaccttcctctcactgctggcgggtctagataaaccgcgggctgggcaaattgaactcaatggtgaaccaatcaataagattggtctgacgaactatcggaagtccaaagtggcaatcgtttttcaatcatataatttgttgacgtatatgtcaccattgaataatctgatgactgccatggcaattacgaactcggaacaccgtggtgacaaggattatgcgatgaagatgttacgacggttaggtattacagatgatcagatgaagaagaatgttcaacgcttatctggtggtcagcagcaacgggtggcgattgcacggaccatggtgtgcgatgctaaactagtggttgcggatgaaccaaccggtaatttggatgaagaaaatacgaaatatgtgattgaccaatttcaaaaaattgcgcatgaacaaaagaagtgcgtcattattgtcacgcatgaaccggatgttgcggacgtttgtgaccactcctaccgattggaaaagcacaaatttgtggcggaaacctagggtgatcttacgattgaatcagacgtgagttgacgcgtacaatcgcatttttgtcaagataagtcactaaaaatgagttctcagaatgatttgattctggggactcattttttgattactgtgaattgctaacgagacaacaatcgtttttgagggcgaacttgccagcgaacgataaaggcgatgatgataaacaagacgagatagagcaccgagatgccaatcgcgtaagcaaccggaatactcaacttggccgcggtgtgggtatgcgtggccaaactaacgacgacggatacgtccgataaggcgtgcaagaaaatcggccagactaagttattggttcgtagataaaggccgcaaaaaatcaggccacccgctgcagcataaaagacttgtgggatgacatagctgagggtcagctggctgctgttaatgagtaggtgggtaagaccaaatagtaaactgttgatacaaatggctagcatgagtcggtgagggaagcattgtcgtagtagtggcaggagcatgccccgatagatatattcctcagtgatcccgataactagggcgtagccaatatagagaattaacgttggggtccaagcaagatgacatagcttgatgaagttgctcgtcattggtagtaataaaataataattcccgggatgagctgcaagcattgtcgtacgagtgattgcgattgccaccactgaatcgatattttaaaccaaaaatgatttaatagcaggaaaataagtaatacaagcaagtcttggaccagcccactgtataaagttggtactggtagccaggcaattaatttaaaaagaattggtactaaaatgaaaatactaatagcggctccccagccgcgtttggttgatgacatcgaaatcccctccagaagttaatgctaactttagtataggtcacattgaaggtgttggttatattaattacggatcgattagttgccggtggtcattacgacagccactggtgattttggcgtagaatcggcagaattaataggataatgaccgcgatttcgatgatttgaaaactagtcgtcgttataccgggcagattgattggaggtgccatcatgctaaagaagtcattgacggcgtgaatcaacaatggccatagtagcgatgtagtctgcgccgtgattagacataaaagtagccctagtacgaaggtaaagcccaattgcaataaggttaaaccaagtgtttggtgaccgagattgatcagatgggtcaaactgaagaggatgctagtgaagatggcggctttcaccacacccaatgttgactggcaggcctgaaatagcattccgcgaaaaaatgtctcttcgaagaggctgatcaatatggcaacgaataacagggtcagggtgtttgttagttgttgggcggttgctaacgtatataggccaattagtgcggccacgattaaggttggaatgacgggccggatttgccgacgccaagttgccgataccccgaattttaaggtttgccgtagccagtcacgatttaatatgagtgcaattgctaaaaagaacagctcttcgaccccagttgttaatgaggatgggagttgggttaagcgtggtagctggaaaatcaggccaatcaacaacatactgcctaacatgccaccccatagtgtgatgactaatttggtttcgtggcgcatctcctcagatccttcctcgtattctcgctactaagcatacgccttttaaatgaatctgagcataaaaaaatagcgtaacgacaattaatgtcattacgctgttcgttagtaatcagttattttataaagcccaagcagccatgccttgtgcgttgtataagctaacggcagcgttaacttggtcttcaacagagccactgctgatgtgcatgttttggaataaaccataggcaccagaagtactgttcttgaccgttgagttccagtttgattcacgcgtgatgatcgtgttccaagttgaagctgaaacgccagtccgtgattgcatttggcttaatacgtagctctttaagttactaccagtgtagcttgaagtcgttgaggttgttgaagctgttgatgatgcagctgagctagtagcacttgatgaagcttgactagtggttgcagcagaacttgaagcttggctagcagctgattgcgttgagcttgctgaagaagcagcactcgttgcaacacttgaagtagcttggctagcagccgaagaagtagcagcagaactagtagcttggctagcaactgattgtgaagaagcactggtagcactggcactcgttgcagttgaagcagcttggctagttgctgattgtggtgcagcacttgtagcagcagaagtcgtggttgttgtagtagtaccattgacttcaagcttatcaccaatgaagattaagttaacattagctaacttgtttgccttttcaatggctgaaactgaagtgttgtgagcttgggcaattgctgaaacagtatcgccggccttaacagtataagtatcagcgttggcaaccgttgttgagatagcgaataaagctaatgcagcagttgatgataatacaaggtttttgatcttcataataattaatacactctcctataatttgcgtgtgttcgattatttacatatattttctattggtcgagcagttgatgtctcaaccaatcaacagtgactagtataactagtgagtgttgcagtgcaataatcagaacattacgtttttagggggtgcttgtaatataaggccgtttttgtaatgaattgtaatatttgagccggatttcatgtaaaatagcgctaccaataccggttaactagctagaaaatcaataacgacaatgattaagcgggaaaactaatgatgaaaattagccgctttatccgataaaagtgatcacttttggtcgatttatgaaaagtcaacgaggattatcgataattttaagtacttaactagtgaattttgacgggttaatttgtcgggaagtctgattacagtgacacttaactagtcattttattgcttggagacgtggcactgactaattatttttcggtaaagcagataattgatagaagttgcgcatcgtgtagtcaattgtggtcggttaacgaaggcgtcgattaattaagtattacttatagtaggtttatgccaaaagtagcccatgacgatcgctactaaaacgttactgggttagtattacgccatagctgaatggtatgtggttgtcgttgtggactagtcgtcaaactgtcgggggttcgggactgtacttagtcaggaaattagttggattttctccgttaaggttggtgaattgttaaataaaaacatgtggtattttggttgggagagtgggtcgtcgattgggggagacaactagcaggtctggatcgtgtccgtcttaaagcggttgctagaataagcatatcgcatatctaaataacgggttgtcagcatgctccaaggcccattataaagtcacttagcaactgagtaactttgtaatgggtattggtggggggacacacgtgcttcagcacggacttaatagtagaaaaaaagattgcgaatcagaaatgatccgcaatctttgcatttatttattaatttaaagtggctttttagtaccagccattagcaagccagtaactcttggcgttgctccatgaaccataacgtgaagcaacatatctgttagcaacacgttcttggttggcagcggagtagtcaccgtttaagtatgaagcacttaattggtacttaccgatgtattgaccgttacgagcagaatatgaaccaccagattctttaccagcaatccaagccttagcagcactatcagaaccattgttgctatagtttgatgttgaactagacgtttgagtcgtctgagcagcaggtttgctagtttgtgtttgacttgattgggtctggctagcttggctcggttgagcttgagtttgactagtctgagctgatgattgtgtcgtggtcgtttgttgagtcgtctgtgttgaagttgaagtcgtggtggtgctatcaccatttacttcaagttgttgaccaactaagatcaagttaacgtcttttaagtggttagcttgttggattgcatcaatcgtcgtgttatgatcagcagcaatggcagaaaccgtgtcaccggctttaacagttaccgtagcagcttgagcggtagcaccaatggcaaagagactagcagtagcggcagcagttgataataaagcattcttaatcttcatttgtaatgtacactcctattttttagtccgaatttggcttggccccgcgaatcttccaagcactcaatggtacctagtataactggcgattgtgacagggaaatagcaggagttttacgaattaccctaattcttgtaataaacggcgtgttttgtaatcttttgtaatataacgcgcggcgcaattgtttctgagcgggtcaatcaaggctgtttacaaatgaagacggtgtctgttggttaacataaccaaatgttgtgattaaagttcgaagcgtgatatcactgggactggcaaccgctgatgtcgtgactaagcttagttaagccaatttacgagttcttttagtggaaatgtaagcgtttgtttgaatgtcagccaacttacttttggtaactcgaaattagtcggcctttaattggaccagccagttgtcggtttgtttattgttaatgagcgattggggtgccgcttgtaggtctttgttaagcttctgaacggtgccactaaagggtgttgacaccagatgcgccccttgatcgtccgtaatcgtgacgagcggatcacctgccacgaggtgctggcccttagttggtaaatcgagttgatgaacgacacccagattgtgttgtccttggtcacttaaccccagtagaagccggtcatgtgatttggtcttcagccaaacgtcgccgtataacatcggagcatgctgttcttcgtaatcatgacgatagaaatggatcatttgtttccaagcagattcttgttttgccatcatttctcctcaattcagtgctagtagtcggtgcatcaattgaaagtggtgcatgattgctaatttcttaattattcctaaccctgggaatttatcgccctcagcgtaggctaatagggtggcaagcgcgggggtgcgattgagtcccgtcaggtgtgcgggtgcccagtcggtgagctttgttaatgcttcaaaaaacttttgcttttgaccacgcatattggcattgctgtccgaaacaaaatgatggatgcgcaggtcaccgttaaccgtaacataaataagatgtaatgcaattgcgcgtgatggcataccgtggtcaaaatagggtcggcccatgagtgagtaatcgccaaaaccatcaaagccaaccggtgtttggtgccagttagcgggggcaaaataggcgtcagttatttcttgatagtccgcaacgtgcgctggggttgccacgggatcagtcaataagaccgcgtgttgtggtaatagttggtgcaaacgcgcttcatcagggattaggacatgaccagcatgctgtaaagtggtcgtatgctgataggccttaagcaacggatagttaggcgcgatgagcaagcttgtttgaccaggactggttgtcagaaagtcgcgactaaaatcggccgcaagaattgcgcccggccagtaaaatgggtagggacgcagatccggaagtggatggagcttaacggtattaagaccatagacactcacttggggattcgcaataatgctaaatggttgttgggcttcaataaaagtcgtgactgtttgttgtaattctttggagtcacggactggttcaattactgggatgatgtgtgggccaagttggtgttgctcgcacaatgtttttaaggctaacaaatcatacatccgtccacgtagataggggtagtaagtgctcataactggtcacgcaaatctggtgccgttagcgcctgatattttagtttgagtgcctgatattcggcattgcgggcatctaattctgtttgtagcgcagtcaccgcgtcattctgggtgtcatcgatgaagcgatcgtacaagttttgttcaggatcataaacgtcgtagccggtgcgggcccgtttgcgtaattctttgaagagttggtcatcagagtagagctgtagtcctttcttcacacgcttggctttatcgacctcacgaaagagcgacgtgatgaagtgactgataaggggcgtttgctcgacttgtaagtcttggcgttgggctttcttagcgacagttaggaaaccaggcgttcgcaacggttggggtgcgagctctagggcccgctgatcaaaagcacggtagatcaatacaccaatatggtctggaatttccgattgaacttctaggtaaagttgttgcggcaagacaaagtaattgtaatgaccgataaatgaaagtttggcctttgaatgaaaatctgctttggtgactttcaattcgtagcaacgccattcaatctgaccatcggggagttgttgatagcttaatgtatcaacgatccctttatcagcgggcatcgcaacttcttcaaccacgtaggcgccctgttctagacagtactgatagagagtactttcaagttgtttagttaatttagtcttcattaatgagtcacctccatttggtgccaaaagttggcaatcgttgcttcgagctgcgggactgattggatcgtctgatagtactgccaatgtgctggaaataaatctgtgtagcgccgactagcgaagcgttggtctaacaagagaacgattccggtgtccttggcactgcggatcaggcgtccagcagcttgtaagacgttgttcatgcctggcagttggtaagcgtaggcgaatcctaagccgttttgatggtcgtagtagtcacgaatcaagttcgtttcagggttgatacccggcagaccgacactgacgatagcgactccaatcaaacggtcgccacgtaagtcaatgccttcggagaagataccacccagtacgcagaaaccgagtaaggtttgcgagggtgctgactgaaactggttcaaaaaggtctgccgggcagttgcatccatcgtcgaggcttgggcggtagttgccacatcagggtaggcggcttcaaaggcagttttgatctgcagcagatagccatacgacggaaagaacacgaggtagttgccatgtttagccgtcaacatggcgtgcaagctggcaataatccggggcacgttatgttcgcgttcgtgatacgttgtctggacgtactgggtgacgagaatggcctgatgttttggtggaaatggtgatggaagctggtaggccaaactgttggcttcaccgccaagcacccgctggtagtaagccatcggggtcagcgtcgcagagaataggacagcaccactgccgagctctaatgaccgattaagaaagtcactgggatctaggcagagttccttgatcgttaagtgatgaccgtcaaggacgaagcgcgtctggtagctgccatcatataggtcgccaattttaacaaaggtcagacaggcgaagaaatagtcacggacggcgtcgagcagtggccccggcttttgttgcgccaaccagtcagtcacaaattcattaaatgttctgagggtgcgtaataatttgtccgggggatcaggtagcacctgttccgttacttggtcatcaatcaaggttttacggatgcgcgtaaaactacgccggactttcttgagttcgcgttgtaagtcgtcacttggctgacttttatcgggcttggctaattttagcaacgcactgattggctggtcactaacggctgcagagtacatatcacgggagcgactaacaaggttgtggacttcatcgataaggaaaaagttgtcgtcatcacgttcgctaaagaatcgttgtaaatagactaatgggtcaaaaagatagttgtagtcacaaataatcacatcacagaagagcgacgtgtcgagtgaaaattcaaacggatcgacagtatgcttgcgagcatactgttcaatcacggaacgggtaatctggtcttcatgggtcaacagatccttgagtgctggtttaagtcggtcgtagtagccaatcatataaggattatcttccggaagtacatcttgttcctcgggaaaccgaatctgatccttggcagttagcgtaatgcttttcagtttgagtccgtcatgactcattagcgtgaccgcttcttcagcaacgtggcgcgtactttgcttagcggtcaggtaaaagaggcgctcaatcacgtcttcgcccattgctttgatggccggaaatagcgttgagatcgttttccccgtcccagttggtgcttcgacaaagaggcgtttttgcaaccgaattgtcttataaacagcgccagccaattcatgttggcccggccgaaaagctggaaacggaaatggcaagtcttcaatagaagcgtttcgttgtcgtcgtaaatcggctcgtaatgtcaaccagtattcatattctgtaattaagtcgtggaagaatgcgtctagttcaccccggtgaaggatttgttgggtcttcgtgattttttcattgatgacttgaaagtaagtcagctgcaacgtgacctgctcaagatcgggatgttcttgcagtaacaggtaaccgtagactttgatctgcccccagtaaagtgtcaacgtgttggtacttaagtcctcgaagacttgatcggatgttttgatttcttcaatcaacgccccatcatcatttaactgaatcccgtctgcccgacccgcgataatgtaatcagtatcgttcatcgtcacaatttttttcaggtaaacttcgctatcatagtcttcaccacgactactctggagctgacgatgaatcttagcaccgttcaatgcagtgttctggctattctttacttcatttaaatcgccttgtcgcaagacgaattctaccaattgtcgaattccaatcttagttgccatcggagaatcccttctgaatttagtcgcttcctattataaaacatctgttcgtgtttgtctgctgttgattgatgatgccgggcggggctctgtgatgtggccttaaatgatggttaagctgcggcagaccaatatttaagacgcgggcttcggcggcttgaatctgggctcgtcgtgttccagcaattggcgaaaatgcctgggagtcaatgtaggacgaactagccagacgggtgcatgctattccgaattttttccagcgaatcttagctggtcacttttgcctttgaaaaactgatacgggttaacaatctggattgaaagctaaataaaaaagcatcgcgataagggcgccgatgcctgttgcgatgtttagattgacgattttgatttagaagaaaatgaatcagactaggaagttaatcgtaccaatggctgtggtgttggcgaatgctcttgcggagactaaaaccgtagctgatgatgccggctgtgataatggtcgctaaaatcgcaagcaaccatgaaccggacgtgctaaagtaggtggcgtaaccaaggctgagactgactaatgtgatgacgggaattagaattctcacaggggctggatgtaagaagacgacaccggctagccacagagccgctgctgtgaccatggcgtcgacactgattggtgaaccaaagctaataccaagagtgatgatagcaagaattgttcccacggtcaggaggaggacagcaaagccgttgctgacggaccaagtaaacgtttttttcatcatgatcgcctcgctttctattaactatattataggctaatttcgccttatgaaagaaataatatgccgacaattaagtttgcaatgttatgaaaattgaaagtttgtgaacaaatccttgaaagcgtatccactattagttaaactggcattaggcacacttgatgatggatggaggaaaaatagtcatggcaaaaattttagcaattaacgccggcagttcaactttaaaatggaagcttttcagtgttcccgaagaaacggtaatcgcatcgggaatggttgatcggctgggattgccagattccgttttcacaattaagaaggcggatggtagtaaatattctgaaactaaggaccaaattgatgcaaaagaagccgctgcaatggtcttaacacggctgaagagcgataatattgtgactcatcttagtgaaatcactggggttggtcatcgggttgttgcgggtggcgaagatttcaaagactctgtcgttattacctcgcaaaccttgaaaaaaatcaaagatttatctgagtatgcgccgctacataatccaacgcaggcttattatattgaagtattccgtgatttattaccaaaagcgactcaagtagccgtgtttgacacttcgctgtatgcggatatgcctaaagttaattacctatatagtattccttacgattattatgagaaatttggcgcgcggaagtatggggcacatggcacaagtcatcgttacgttgctaatcggacggcccaactattggggaaaccattggattcgcttaaattagtgacattacatttagggtcgggtgcttcgatcacggcttttgatcatggtaaagccgtcgacacttcaatgggctttacgccgctagctgggattaccatgagtacccgttccggtgatattgatgcctcaattattccattcttgatgcgccatttagggatctctgatgtggaagactttgttgacattctgaatcataagtcagggttacttggtatttcaggtttgtcacctgatatgcgtgatcttgataagacgcaagatacccgtgaacggtcaaaattagcaattgatatttttgttaaccgggttgtgaagtatgtcggcagctatattgctgaaatgaacgggattaatgcccttgtcttcacggctggtgtgggtgaaaactcatggatgatccgcgaacgtgtcactaaagccttaggatactttggcgtgacagtggatgatgaaaagaatcatatgcacggtaaggaacaaattattagcaaagatgacgaaccggtaacggtcatggttgtcccaactaatgaagagctgatgattgtgcgtgacgttgaacggttatctaaagctgaataaatgagtcaattaaaaacgcgtgattcggattgtggtccgagtcacgcgttttgagttttggattctaatcagcatagcgctaagtcagctcttgtccccgcatatgtgccgatgtgatgtgctcagctattggcgttgtcgcgcaggtttagtcattttgatgtggggcgtgtggttgaatagaaaaggggtaccgctcgaagtgaagccgaaatgctggtaaaatccttgtactggcacttgggcttcaatttgaattggcaaatcagcatagtgttcctgtacgacctgttcgatatgggccattaaatcagcgcccaagtgttgtccgcgttggtttttgtccaccacgacccggccgaaggagagatggtcatcttctgtaaagattcgtgcgtatgcaataatattttgattgacggttttaaagacatgataagcttttaaatcagtatcgtcgacttcctgatagatgcgttgttgttcaacaacaaacgttttgacgcgcaattcataaatagcgtataattcagttgttgttagttctgagaatgttttaatcgaccacatggtgatgcctccttagcatagtgctaagtttatcatcaaatgattgcatatgcaataataaaaaggagcttctatgataccaacattaagattgatgggcacgctgtcgcgaatcgtcacgaacgagggtaatcaacgttttgcgaaatacggcctcaataacaatcagtttatttatttaattcgaatttgtgagcagcctggcctattttttagtcaattggctgaccaaatgaagatggatcgaaccacgaattatcgcgccgttcagaacttaataaaaaaaggttacgtgattaagcagacacatccagagaataaaaaggtccggtgtttgtacccaacgagcgctgggcaagcgttgtacccggaattgcatgcttatgagcagtggtgtgcagacttggttggtgagcagttaacgccgggtcaacaacaagttttgtttgaaagtctgtcgttagtcacggctaatgtcacccagcatattgagtaagtttaatcactaaactagattaattgtgaacaattaaaatggcgtggcgttttagctgaattttaggcgtgaagagtgtaccatgtagttatcaagttataactggattaatgtgatcaacgcaggttagcacaattgctggacaggcggcattagtcaacagggataatgaaaggggttaataaatcatggcaacaactttggtgttaggtgggggttacgcagggatgcgagccgtcaagtttttacagaagagtctaccaactgaggatgaaatcattcttgttgatcagacaccgacgcatacggagaagactaatttacacgaagtcgcagcggggacgatcgcacctgatcgaattacttatcagattccagatattatcggtaagcgggtccagttcgttcaagcaacggtcaagagcgttgatattgaacaaaaacaagtgacctttgaagatcatcctgaaatgacctatgactacttagtattagcattgggcttccagtcagaaacatttggggtagctggcgccgatgaaaatgccttgccaatggatgatttggcaacttcacaggctgtttatgaacatttggaagaacggtttaaagcctaccgtaccagtaaggacaaaaatgatttgaagattgcggtctgtggtgctgggttcactggaatcgaattattaggtgaactgacccagacgttaccaagattgaaggcgaagtatcaaacacctgctgctaagttagtttgtttggaacggatgccatcaattttaccgatgtttacgcaggaattgcgggactacgctttgaagtttatggaaaagaataatgtcgaaatgcggttaggtgccgttattgaggccatcaaaccgggtgctgtggtttacagtgacgcggacaagaacgaacatgaatttacggctaacacgattatttggacggttggtgtcagtggttcacacgttattgctgattccggttttgatcagcgccgtaaccgggtcgtagttaagcccgacttatcgctggaagggcatcccgaagtattcattgttggggatgtcgctgcagtgatggatcccgaaagcaatcggccatatccaaccacagctcaaattgcactggcagctggcgaacaggctgccaagaatattggcgctttgcgtcataaccaagcaacggcgacgttccactatgaatctagtgggaccgtggcctcattgagcgatcgtgacggtattggtgaaatcttcagtagtaacaaaccggttcatggctacgcggcatcagcattgaagaaaattattactgaccgctcacttttggaaagtgcgcatttaggaacggtcttcagtaaagggcgttttgacttatatcattaatcattaaattaattccagtagtatgataaatagccaccacagaaatcgaatttctgtggtggctattttggactagttcactgtcgaatggctcagctggttgctaattcgggcaattaagtaaccagctgttgggactaacgatactttacgggcaccccttacaattaaggcatgataagggggcggtcaaaatgacgactaaatcaatacgaacaccaattcaaccgtggtttaccctagtggtagcgggcagcttactgataaccttgttttctaatgcactttggtggttggctagcagtgcgttttgcgcgctactcgttttaaacttacaatttatcgtctttcccaccaccgcggattgttattggctaaatcggctcagtttaggattagtgctagcgctagtagtgatagcgaatattaaatttttactcattagtggtctgacatggcggtaagcgcctagacattaaaggacctgacttgaagcactctgtttgggtctataatctttagtgttgatggataaaattcatcaacactatttttgtgtcgtataaagtacgatttatctatcaaaattagaaactataatggctgttgttgttaattcaagcaaaagtgcaatgtgtttcccacgggaaacacattgtgatatagttattacaagtgaaaattcgattgtgagttggttttgaatgtcccaagaggaagacgtcaaagcgattgttgctttgataaagttgaaaagaaataattggcaaattagtcatcgtgcaaagaattattcagcagcagtaacgttaggtatggatttagatggaattttagataatatatatcaaaaaattacatggcgcgattatgttaatggtccaatggcagataatcaccaccccagaatcccaggagatgtgtggctctttggactagacatcgaaaatattgaatgttatctaaaatttcaaattaaaggcggcaatataatattttggatttcaactcatccagctgaatactcgttggaatatccttttaaataatagactatttttactttacgttcttggaggtactcattatgaccaaaaaaactttttacaatgaagaattaaataccactgaagaatattcggaggtgtggaaatacgaactcatgcgagtcaaagacatatctgacttgatagtccataatcattactggaaagattctcgaggagaactttggttggattttgatgaccccaatgagaattttagaaaggcctttaatgcttatagaaatcgaaaaggattcatgcaaccaaatgaaataaaaaagttacgagaaaatttgcacttaagtcagcgcgtcttttctgaacgattaggtattagctatgcaaaagtatcacagatagagaacaataaacgagttcaaacgctttcacaagaagtctcttttagaaaagcacaacaagattacgaaaaacagggattcttgacttcttatgattcagatacgagtgatagtgccgaattaactaaggttttaactgaaacagaatatgtagatacggccaaatatttctataaaactaatgattcttcagaaaccacaatctttaaagttcaagaatttgttggaggtgttgcataatggcagttttagaatttaaaagctatacagttaatgagttgagttatagaaaaaacgatttatataaggaaactaaccagaatattagtataaatcccaaaattgaaattaaaaatacgccaaagcaagacaaaattattgtaacagttgatgtgcatatcggatcgctggcggagaagaaaaatccatttatagttacggcgagcgtcagtggcgaatttgtctatcatgagaaagaagatcataatcaagttggtattgatactttaatcaagaaaaatgctgttgccattctctacccttatgttcggtcgctagtatccggtataactaatgcatcaaaccaatttccagcacttattttgccgactataaacgtggcacaattacttgatgaacaaagtaatcgtcaagaagctgctgactaaggtttataatacaaataaatcgtatcatatgataaatatgcagaaagtgtatctaactataggatagatatggttagttgcagtattcataatcaaaatatctagacaggaaaacatctttgccactattagtaatttagtgacaaagatgttttctcttatatattcctaaaggttaaaagattatgacaattttgaaaagagcgattatcaatcctttaaagtaggcccaggtaatgtaggaaataccactcctcagctaatgactaatattaaaatgtttatcaataaccggtaaaaaattattgattgaattcggattgcattcaagacgagaatcgaaaaaggatccaattcgtagatgaattgaatcctaaatataacttcatcgtctctgatcaacagagtttcctttgtttcaaatcaagcccttttagcttataatcgaccgttctttgatgccagtcatttgaatcaagtaggctgatccgattagtgatgcatcttaaattccaaataacggtcattatacaagccgactttggctggtgataaatcttgatagatttgaagatgcttgattgtgttattgtctgggtaaaattggcgatcgttgcgaatggccttaggtaatagcgccttggctttccgattaggtgttgcgtaaccgatatattccgcattttgggcggcgttcttgggttcactcataaagttcaagaaggcgtaaatcgccttaaagtgtttggccgttttaggaatgaccaagttatcaaaccacaagttactcccttcggatgggacaacgtaatgcaagtgtgaattgccagccaacatttcactagcctcaccggaccaatcgaccgcgattgcggcttcgttttggatcatgtacattttaatttcatccgccacgacggccttgacgtttggtgatagccggttaagcttgtttcgcgcagccaatagagtggctggatcggtcgtgttcatagactgattcattgatgcgagggcgaaccccattacgtcgcgggcgctatcaatcagcatgattttgttatggtattttcgttgccacaaatcattccagtgttgaatactgcccggctgaacgtacttgtcgttataaatgataccaagcgttccccagaaatatgggactgagtaacgattgtgttgatcaaaggccaagttcatgaagcgcggatcgtaattcttcattccagtcagtttacttttatcgagcggtaagagtaagtgcgcttttttcattttttcaatcatgtaatcactaggtacggtcagatcgtaactggtgccgccttgcttgattttcgtatacatagcttcgttgctatcgaaagtttcgacgttaacgtgatagccagtctgcttttgaaacttagtgagcaggctggggtcgatgtagtcaccccaagtatataggttcaaaatctttttgccagtactaccagagctcgtctgcaagcgttgcgcgccaaaggccagtaagccacagacgactagtaagctaacgatgatgcttaataattttttcactttcgccgccccctaactgctggccgccggtgccgactactgtattggttaatgaagtagtagccaatcactaacaccagtgccatcaggaacattagaccggacagggcgttgatttccaggttgatgccttgacgggcccgtgagtagatttcaaccgacagcgtgctaaagccgtttccagtcacgaagaaagtgacggcgaagtcatcgagtgagtaggtcagggccatgaagaagccagaaaagatcccgggcatgatgtagggcacgatgacttggctgagtaattgccaattgttggcacctaagtcagccgcggcatccagtaaactggtgctcatttcttgaatttttggtagcaccatcaagaccacgattggaattgaaaaagcaatatggcttaacaagactgagccaaaaccgagcggaattttaagggcagtaaagaaaatcaagaaactggccccgatgatgacgtcgggtgaaaccatcaagatattgttcaacgataacaaagtgttgcgggtaatcggtttggtcatactattgattccgagtgcccccagcgtgccaatgacagttgctaataatgatgataagagcgcaatcaaaatggtgtcgagaaaaatggcaattaaacggctatccgcgaataagtcttggtaatgttgccaggtaaaaccatgaaagttgttcatagtcgtaccttggctgaaggagtaaacgaccagaaaaataattggcgcatacagcacgatgaaaacaagccacaggtataagttgcgccacttgaagttacgtaaggtcattatttcgtcaacccctttcgcgcgcgctttttactgctgccagttagccacatgatgatgaccatcgcaataatcaggacgaccccgatcgtcgaacccatgccccagttcattgtcgtcaagaagtgttcctcaatcgcagtcccgagtgtaatcaccttattgccgccaattaaacgggtcaacatgaagagtgacagtgagggaatgaagatggcttgaatgccagccttcacaccggggagtgtcagtgggaaaattacccgattgaaggtctgccaatttgtggcaccgagatcccgactagcattgacgtaagatgggttcagttcgctaatcgagttgtaaatgggcaggaccatgaacggaatctgaatataggccgcgacaaagatgaagctgaaattagtaaagagcaattgcttgggcccgattccgatgaaacttaaaaactggttggcgatgccggcttgactaaaaatgccgatgaaagcgtacgccttaagtaataagttgatccatgttggcataatgattaagagcagccacagctgcggatgcttcgtttcgttgagtaaataagccgtcggataactgatcaataatgttgcgagtgtgatcaagaaggcgtaccagacagagttgagcgtcatcatcaagtaggtatttgatgaaaaatacgtttggtagttgcccagtgtaaattgcccgttaatgttgaagaatgattgatagatcaacaataggactggggcaatgacgaagaggatgatccacaacatgtacgggataaagtaggcggtgttacgacttaatcgttgttttggttgcatgttgacacctcctaatcatcttcgtattgttcaagacgagcatcaaaagcagcttcgctctcgtttaaccgcatgacgtgaatgtcttgtgggtcaaaggtcaggccgatcggttcgccttctgcggcagggttagttgaatgaacgagccattcgttatgatcggtatcgtaagcgacgatttcgaaataattgcctcgaaatagttgggagtcgacagtgacgactaacttgccttgatctgcggccacaatgtcgagatcttcaggccgaagaacgacttcgacaacttcattaggctgcattcccgcatcggcgcattcgaattgtttgccgacaaactctacttcaaaatctttgagcattttacccggaataatgttactttcaccgatgaagttcgccacgaaatggttgatcggttcatcgtaaatatcaactggggacccaccttgtaaaatctcgccagcgttcatgacaaagatttcatcactcatggccaaggcttcttcctgatcgtgggtgacaaagagaaaagtgatgcccaggcgttgttgaaggtcccgcaactcatattgcatatccttacgcagtttggcatcgagagccgataacggttcgtcgagtaagaggaccttaggctgcataacgagtgcccgggcaatggcaactcgttgttgttgtccaccagagatttcactgatttcacgttctccaagatcggctagttggaccatcgcgagtgctttttggacccgcgtctcgatttcatccttgggaactttgtgtaatttcaagccaaatgccacgttttccgcgacattcatgtgtggaaaaagggcgtaatcttgaaagaccgtgttgacttgccgctgattagccggcagggtgttgatgacctgaccgtcaaagtaaacttgaccggaagtggcatccgtaaaccccgcaatggtacgcagaatggttgttttaccacacccagacggaccgagtaacgtatagaatttgcccgcttcaagatctaagttgatgttttttaaaacttgatgttccccgtaacttttagtgacatttgtcaatcgaatgattggttgtgtattaaccgccaaagtaaagacctccttaaaacgtgtaccaagctagtgtaacctaataccagctcgatttgttgtgacatgattataagtaggacgcggtcgtaaccaaggtgaacgtgcaggacgtggtgccaagattacgaatctgatgcgtcttagtcgcatggaagtacagcgtatctcccgccgtggcagcatattgctgagctccgagctgtaagcttaaagtgccggtttgaaccataataaaggtctctgccggcgacggctcaaaagatttgaagcgaccactaggtgccagtgtgacggtgaccggttctaactgattttcgttagacgcgggtacgagccatttcacacggtatcctaaggcttcatcgtcatacgtggtctgatctgctggatggtagaccactttgtgagtgggctgctcagccgcaaaaaaatcagcgggggtacaaccgagtacttcaagaatcgcgaagaacgtctccattgaaggcgatgactgattgtgctctaactgtgatatgtaccccttgctaaggtcagttcgttcgcctaattcttcttgcgtgagttgcttttgaatccgtaagttgcggatgcgttgaccaatgtccatgacattcacctcgaatcggtagttttgttaaactaaacaataagtttagtacgagctttaattataatgaaaaatgacgtggtgacaagcattttttacaattggcagcttctttttttaagtctgccagcttgtctggtcaaatcgcccagaaacagtggtgttgaggggttggaactgtcgtttggttagtgaataaattaggtgcgttgtggacggacttttcgtggcgtgccgctgaagcctgcgctggctaggcaatgctcagcctcaacccgcggcccctcacactctaataaaaaagcccaagacatccgtcttaggccgttagcgttgttgattaatccgcgcggtaaacgacttcaaaaacttcactgaccatcggtgtgtccgatgagaggtttttgccgtgttcttctaacgtcggggtgaattctgccgtcttacgcttgcgccaatcaccaattgtgcgatcaccatcgccttcatggtaagcgtgttccgccgagatgcgataaaacggaatgagttcagacaccaccgttttcagaatcgcgaccggtttcatgtcaccatttagcaagacgttgtagtcgccaacttgtggaatggcaatttgttccgcggtataactgtccagcggcgtggttgtcgctgtcttcgtcccagccagaattgcgtcggctaaagcagtcacttcggcagggttattttgttgaccgaaccaacgtgtttgataagaagccccgtttgtgtcggtgctttcgttataagcatgccataattgttctgctgattgagcgggcataaaggtcacctaatttcgattagaattattgaattcgaatgcatgtaaccgaattcacaattcaagtatagcatgacatttctgaaaacgacacgttcgacactggtttttcggggaaaattaagttagtcaactattgaccgacatttgctataatatacgtacgaattggagggcgaaaatcaatggaaattacacctgttaaaatgctggatttaccacaaatcatggcgatcgaaaaatctggtttttcagaagcagaggctggcagcgaggctgcttatcgcgaacgcattgagaaattagcggatacttttctggtcgcccgcgatggtgcagtcgtacttggctttatcgtgggaccagctgtcggtgcccgctatattgaagatgagatgtttgtagagacaccgactaacttgccacgtggcggccatcagctggttttcacgttggcagtttcgccactagcacgtcaccaacagatcggtagtcaattattgaccgcgctagctgagaaggctcaagcagacgggcggacaagcatggcgttgacttgtttggaacgactaattccgttttatgaacgtaatggttttattaatcaaggtgtggcgaactccgaacatgctggtgaaacttggtataatttagagaaagtctgggattgaatcatgaaattagcaacattacaagcacaattaccggattttgagatccgattactaactttagctgaccaggaagcattgctagagctggaacaaagtaatccgcgctatcatcaatatttctcaccggaaccactaacgatgactgaggtacaacatgatttgacggcccacccggacgagctagcggcggcacaaaaacaggtttttggtttttacttagcacaccgtttagtagccgttttagatgtactcaatcagtatccacaagaacaatttttattcgttggattactcatggtcaataaggcttaccaacgtaaatcagtgggccgagttattgtaaccggactgatgcaagcggcacttcaagcgaatataacggcgatccaactaacgcgcgttactgctgatgaaggggtcgcaagattctggcagaaactcgggtttgaagatggtaaccagttgttcttacctttaaaagccggtggccggttagcggtgacgacgatgacacggctactccaatagaattctcatggaactcttagcaataaggcctagtaagcgatatcagacatgttaaactcgtgatgactaataaatagaaatgaggttaacacgatgattaagcattggggaaaagccgaaactggcatgttgattgcagccgtattgttattaatggtaatttttaccttctttgaaattacggctagtttaacagttagtgtcattgcttttccgattagtttgattgtgttgatggcgattatggaattcgccgcaacggaattacggcgcaagtaagtgactcgcaaatagatcgtaacctaatatcgtgcttgtttagcaggagcacgtatatatagaagcccgtatttaccacgattggcagatacgggcttttttcgtgacggctgaggactattcctactaggtctaaaggacactgtttggactgtacaagtggcctgattttaacgttttcttagcttgtttataactgtactatactgtactatttaacgtaagcgaagtaacgactgtgtattaaatggaggtgggccatgcaaattgatcatggaagccgacaaccgtattacgctcagatagtaaccggtattgaacaagatattgctcatggtgtgttacaaagtggtgaacaactgccgtcggtgcgtgaaatggctcgtcaacacttgctgaatccgaatacggtcagtaaagcctataagcgactggagacacagcaaattatcgagacggttccgggaaaaggcacgtacgttaaagtggtggattcaacgctgttccgacaagaattacgggaacagtttacacaaattgtcaggctagcgggtcaaagaggcgtcagtattgatgaattgcatggctggcttgatcaaatgggggaaaaataatgagtttagtgattaatcagttaagtaagcgcattgaccatcaccagacgttagatggcattagttttgagattggacttggtcaaatcgtcggtgttgttggccgtaacggggttgggaaaacaaccctttttcggacaatcaatgggcagtacctcacggatcatggtcaggtcctggttgatgggcaagaggttgttgatcaaccggaaatgcggacgcaactgtgttttattgatccactggcaaatttttttaaaggcgcgacgattgcgcaaatccagtggtattatcaagctgcttacccggactttgataatgccaaatttgcgcaattgttagaccgttatcatctgacgtccaaacaaaaattacgccatttctctaagggaatgtttggtttgtttacaatcattctcagtgttgcgacgcaagcgccgtatctctttttggatgagccgctagatggtttggatgtcctaattcgaaaaaacattcttggtattctaattgatgaagtggctacgggaaaccgttcaatcgtgattgcgtcacataatttggctgaattagagggggttattgaccgcgcgttgatgcttaaacacggtcgcattgtcaatgactatcaattagaagccatgcgacgaagtgcacgaaaagttcaattagtgtatcgtgacaagcagattccagccgttgttaaacaattaggccatattgtacacgtttctggtcgggttatcgtggtagtgtttgaagattataatgctgaggtccaggcgcaattagcgacaactaacccggtatttcaagaagatttaccactctcattagcagacttgtttatggctaatctgacggatgaagctgactttgaattattatcttagggggacgataaaatgacgaaacgaaagttatggcagttgttatggcgccactatcgcacgttgttattaacggcgggcggtgtcttactactagtaggcataaaggaaggctacagtattgcccataatccgtcacggtatgttgcacaaaatgtcagtagttttgcgttgatggaagccactcatcttcggatggaaacggtggtcgccatcatcgttagtctggtgctaggagtcgcactattcttaagcgataatttcacgaattttaatcaatatttatttagtttgccggtcgctcgaaagcaaatttatcggcgtaagatcgggttacttattgggatgttggtcagcgcatacatgttggcggaagctgtttttggactgattgcttggcgcgtgttggctaaacagcaggtgcggattgattggcttacgacattgtatgaagaacttggaatcctggcagtaatgttagtgtttggattattagccgctacgttcgggttatgggttggccatatctttgcgagtgcgcttgcgacatttgtcttcgtttgtagcttgccctttgcatatgatggcttgatcaatcttgctgcaggattaacgaagcttaaatatgagcaggtggatgttttaggtcagctgccgagctggaaacccgggggcttactaaccacttgggtgatttgtggtgttatcggtggcggcctgtatttgcttaaccgctgggcgtttgagcatttatctttggaaaatagtggggattttttccgctttccgcagtggcgcggagccgtcctgggcttttcaattatttatctaattgttgcaatttgctgttcacaatttggtaacggtgttttagggttgctaacggataactatcatgcgcatatgccattatcgactgggattataatggcgctggtcgttgcctatctaacttggagtttggggcggtggtttctgtaccgaccggatcgttttcgcgatgcgtggacggttaagaagttggcttaacttggtcataaatctaaaatgcgcccgttgaagttaagcagactgacttcagcaggcgcatttgttagcggcaattttaaatttattatcctgattgatgaaactttagcgaatcttagttaagcgttttgcaacggtcttaatatttagtagatcccaatcttccaagttgtgtgaaatcgagttatgcccccatgttccacaaccgagtgttaaggatggtgcgacgttatcatatttataaccaatggcaccttgtgaagacggcacgttgatcaatgctcgacaagcagtcatttctaaggcaaacttgttcataacagcttcgtcagtcgtatgcaaggcggccgtatgtcccagtccgccaagtgctaggctgcgtttcatcaggttgaagccggcctcagtatccttggcatgaacgacggcgaggactggtgataacttttctcgtgataagacttggtcaccaccgatgctaggcaactcaactgctaatactttggtatcggatgggacatcaaagccagcccactgagcgatttgccatggcgtttgcccagctactttcgggtcaacagcctgtttatccaggttcatgacagttgcttctaaggccttgaagttctcggtaccgacaaagtacacaccgttgtgacttaattcacgtttaacttgatcatagatttgatcagcaacgattaagtttgattcggaagcacagatcatgccgttgtcgaatgacttggaagtgacgacatcactgactgcctgttgaatgtctgcggtttgctcgatgaagcatggcacgttaccagggccaacaccgagtgccggtttaccagttgaatacgcggtcttgaccatgccggcaccgccagttgcaataatggtagcgacgcccggatggttcatcaaggtgttggttgcttcaaggctaggcgtcttgatccactgaatccaatccttaggagcgccagcggcaatagcagcatcgcggatgattcggccagtttcaacacaagatttttgtgcaaagggatggaaaccaaaaataatgggattgcgagtctttaatgctaacatggcattgaaaatgacggttgatgttgggttggtaactggggtgacccccgcaataattccaactggttcagcaactttcatcacgccactgactggatcgtcattaatgataccgaccgtcttgtcatccttgatgtagttataaacgtttttggctgcaaagtcgttcttcgcaactttatcacgataatttccgcgacccgtttcttcgacggccatagcggccagcatgccacgagcagcgtgggcagcgcgggccatggcagcgacagcctgatcaacttgactttggtccatgacttcaagacggttggcagctaacgaagcatttaagactaaccgatcgattgaacgtgatacggttgtttcttccatttctttcagcattcacggttcctcctatgcaaaatcaacttgtttcttatttcacaatcactattataaatactttttcacaaatgtaaatagctaatatttaatttcataaattgcttttgaaacactataattattgatttaatagcgtatataaatgtagataaactgttcgcttacattttcaccgaacggattgctgttataatattcacaattaattattgattaaattcgaagcaacttttggcttgatctgtaactgattttatataaatggaagggtttacaaacgggcggttgtcaaataagcaagaattgacggggaatcgttggttaataaatatgacaaatcggttatcactcctatgtaaaatgtgctaaaatgaatgtgattcaaaaatcgtatctcttaattaacctaggagggttattttatgtcatttgtaaatgctgttgatatgacacaagacgcatacaagaaccattatgctattggtgcgttcaacacaaacaaccttgaatggactcgttgcatcttgaagggtgctcaagacactaacaccccagttattatccaagtttcaatgggtgctgctaagtacatgggcggctacaagctcgttatggacttagttgctgatgaaatggaaagcatgaacatcactgttcctgttgttatgcacttagaccacggtaactacgaagctgccaaggaatgtatcgaagttggttactcatcagttatgtttgatggccatgacctaccatttgccgaaaacttagaaaagactaaggaaatcgtcaaattagctcatgctaagggcatctctgttgaagccgaagttggttcaattggtggtgaagaagacggtatcatcggtgaaggtgaattagctgatgttgaagaagctaagactttagctgctactggtatcgacatcttagccgctgggattggtaacatccacggcaagtacccagaaaactggactggcttacacttcgatcgtcttcaagaaatctcagaagccgttaagatgccattggtacttcacggtggttctggtattcctaaggaccaaatcgttaaggctgttgaattgggtattagcaaggttaacgttaacaccgaaaaccaagttgcttttgccaatgcaactcgtgcttacatcgaatctggcgcagaccaaatcggtaagggctacgaccctcgtaagttattggcacctggtaagaaggccatcgttgatgttgttacatcacggattggctggttcaagactccagctgttaaataattggatttttgattcagaaaaagtcgactcttcggggtcggcttttttcctgcgcttttttggggaacttggtactgacttaccacctgggagtgccagtgtcagtgtacccttttctggttgctattatcggggaaccaattgtagcgtgatttttaattttgcggtttgttaaaataatcgtaacttaatgggatgctgttggtatccaattgaatgaaggaaaaagtgaggtcagtgattctcgaatgccgagggtcactgacctcattttggtgttaagaacggataactaaacattaatcgcgtcttgcaattgctgctcattgtaaaaaattaatacgataaacatcaccacgtaaagtaataatggtaaccacgcatagttcagggtaatcatatgctgagtggcgatattttgcgcatgattggccgtgtagccgcttagatgaaagagtccggcggtgactaggccaccaagtcctaagccgacattgacgccgaagtcatcagtagaggctaaaataccttctgcttgaatgccaagcgccgtgccataacggatcgtatcagcaatcatgattgagaccaaaccaatgatgagaccgttaccgacagcattgatcaacgtaccaccgaagacgaaggccagttgattgatggctgtcccgagaccgaggatcagttgccccacagcggcgattgcgatacccgccaacatggtattctttttcccgtggtggttggctagccggacaattaagatgaccccgatcagtgacgcaaacgtaaagccgttaacgactggcactaagtcctcacgctgaatcaagtatttaaagtagtagatggtcgtttgattcttgatggcagttgttaaccaatacagtaaaatcacgctggataaaataaaccacggctggttttgcttgagcatgccccacaccgcactgagtgattggtgcggacgctcaggttgactaaagcgttccttgacttggaagaaggtgttgaggatcaggaccaacgaaataatgccaaatagaacgattgtcagtaaaaaacctcgttgctgatcaccctgaccaaataaagcaactagtggcaaggtgaagacagcgacgataatttgaacgctactaccgaagaattgacgaatcacgcctagtaaggttaattcacgttcattctgggagagtgctggtaaaatcgatgtgattggtaggttgacggcggtatagaagaatcctaaccctaaataggtcacataagcccagacgagtttaccagttgctccgaaattcggggtcacaaaggtcaaaacggcgaacaagacgtagggtaacgcgtaccataagaaaaacgggcggcttttaccgaagcgcgaatgggtatggtcaatcatgacgccgataatcagactttcaacgacatcggctaagcgcgcaacgacaaataaaatcgccgctgcactcgtggataggccgtaaacatcggtatagaagaataataagtatgtggtcatcatctgaaagactaagttatccgcggcatcactgagcccataactaattcgttccggccaagctgtttgccaaggttgtttcaatattaacacctctaagtatggttttgcacaatctaattctaacctagttgcacgcttaaacctaacggaaaggtttacaaaattgattaggtcttagattgatcagaaaaaagcctgcaggtggcgttcgtcaacctgcaggctgtgcattgtttgtcctgattaaaagctacttagttgttaatttgctgaccttggtgagtgctgggattaagcccaagctatctaacgtttggtttggtaaaacaacggtgttggcattgccgtccgctaaggctttgacagcttccgtgttttggaagataaagtagttttcggatgattgtgacaaggcttcgtttaagatccgcgtccggtaagcatcagcatctgcttcagtttgaacggctgttgctttcgcctttgcactattcactaaagcttcgttttgggctttgttggtggctaataaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacatttaaaccgtagcccgccgtaacggaggagatctccttgaagagggcggcattgatttcttgcgtcccattcaggacttcgtttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttgattaagatcaacgggtgtctgagccgtgttaacggtgatgacacgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatacctaccataataatttccccctattgttgtggtgcgataatcgttaccgttagaccatgagcactgacggccgtgatttcaacggtatcgccgatgtgcagtggtgttgcggcgtgcaaatggtacaagatgccatagaatgcgacgccgtcagttagatcggtcggtttgataatgaaacgctgaccgattaagcgctgatctaagtatccctcttgcatagatgacccacctttaatgtgataataattaaattatatgctgtttttggttagattgatagggccgttataaaatagtgggtgagttttggattgttgataaagtatggcgataaatggtgaattcatgctgcatatcgcccagtagctattgaataagctcgttttagagggcggttcagtaatacgggattggcgagttaaaggggtgcttgaagtatttaagccgacaaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacggatttcattactttggaggagtaaatgaaaagaatgttaattattatagtagcaatcttggagggggatccttaattgctatagatacatattaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttgggaagaaggcgaccgttgatggttcaacgatgattgcccgcaatgatgatacgtttatgccgattacaccgcaaaaatttatcgtccatcccgccgttcatggtcgcaacgaaacgttaacttctgggaagaatggctttaccgcaccacttccagcggatggctaccgttaccaagctgtaccaaacattgaagtcgctgaaaagggtgtttttgaagaaaatggctttaacgaaaaaaacgttggtgtttcttcaactgaaagtgtttatggtaatgaacatacgctgacttttgacccattcgtgtctaatggtctcgcagaagattcattgccaaccatgctcacgccgttcattgattctgctcgtggtggggttgaatacttgggccagttgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgattttgatgatcccgataactttatgtggtctgatggtattcaagaatttgttgcggaacaccatttgaaccctgacaaggaaggttttaacttccgtcatatcttcggtactgataatgaaaaagaccggcattataatactccccgggtctggtacggccaacgttatttcaatccagagatcgaacaagatccacaatcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaagtgcggaatgacgtaccagcagaacaaagcgcgattatgtggatgacatttggggtaccagcttttgcgccatacctcccattccatgcgaacgtttctgaaactgatcctagttttgcgaacacaccactaaaacatgatatgaatagtgcttactggctctaccggacactatcaatgattgttgaatcacactatgctgatttcgttcaggatgatattgattatttgaaagaatgtcgaatcgaactgggtcaatttgtggctgcgaccgatgaacaagcggcgaagttatctggtgacgagttaacggctttcttgactgaacaagataaagtaatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaggttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgacttactgacagccgatacgccaagaccagaagcacgtcaatatcacgttgaaaagcgtattccaaaagaatagttcaatcatcccatgatcagtaaaaagggtcatgggattttttattttctaaacagtaacccatgatgttgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgtcccgattgtgttgcagaatatgggcatctttttagccgccgagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataactcgggcgatgacaagtggttattggtggctagaagttggcattgtctggttggctggtatcttatttgttgatgtaatcggtgctagttggctagctgttcagtctcatatgactttgacggccgccttgctgtcgaacgtggcctttcttcctggtgacatcattaaagggactttggccgtatttattgcccggcgtgtgcgggccatcgttgattttggattgccagcttagtaaatagctaatgtgattggcaggtcaggaggtcataatgacaactaaagaacaagtcttaacaattttattgcgtcatcatggtgagtggcaatcgggggaccagcttgcccaatcagttggctgtagtcgtgagagcatttggaaggcaatcaatgctttgagaaagcaaggacaccagattgagagtcgtaaaaaccggggctactgttatctgggaagtcgtaatttggatgccaaagccattcaaatctatgggcaacgtcaatttacggggtcccttgaagtggtcgcccagacgccgtccactcagattctagctaagagctttttaagtcatcatcagccacagtttgccgccttcttcgcggacgaacagacggctggctatggccgtttgggccgggacttctattcaccggccaaaactggactgtattttagcttggttgttcctaatcccacgaatgcattggtcaatgtgggtttactgacaactggtgtcgcggtgagtgtcttgaatgttttacagcaattttatcctaataagaactttgggttgaaatgggtcaatgatatttatcttgatcagtataaggtcgggggcattatcacggaagcaagtttggaattagaatcgacttctgcaacggcctttattgtcggtgtggggctcaatttaacgaccaccgattttccacgggaattgcaagcccgtgcccaagcggtcgacccgagcatgtcagtggatcgcaatcggttagcagcggccttattatcagcactagtagcgctatcaaaacgctacgctacggccgactttttgccagcatatcgggctaaatcattagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatatcgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgacaaggtttactttctaatcgatgagagagaagtacagtccaagtgtcagtaaaagtgaggatggtgctagtttattcaatctaatttaatattaataaaagtcttgacataatctaaccaaaaactcataatgtgaaatatcatgagagatgagtatcaatggtgagctggtaacagagagtcgtcaagtgctgaaagatgacccagcaagcgttgagaagatggtctttcctaatgaacgatcggtgagcagtgatgttaagtggtcgcggttaatgcccgttagcgcagcagttagttctgcatgagttggtgtccaaatgggtgctattaaggtggtaccgcggcgaaagtcgtccttgttataatttataacagggacgactttttgtcatgtaaaaaagtgagaaacggggtatggaagatgagaagaaatacaaagtggttgttagctttaggtggcattattgttgttttggtggctatcgtggggttcagccgtgccagtagttcacaagcaagtcagggtaagttgacaacggtcaagattggggttgctccggggccttatggtgatatggcgactaaagttatcggcccattacttgagaaaaaggggtataaagttgttacaaaggaattcaacgactacgttcaaccgaataaggcactgaattctggggaaattgatgctaatttatttcaacatacgttgtatctgaagaccttcgctaaagctaatcacttgaagttatcggccattggcgagacgcccacgctggggatggggatttactcgaagaagatcacggcactatcagatttgaagtccggtgatacagtctcgctaccgaatgatccgtccaacttagctcgagcactacaactcttagcggcgcaaaaactaattactttgaagaaaaatatcaacgtcgcaacggctagtacggcggatattgtgactaatccgcaccagttgaagatcaagaccttggatgcagcccagttaccacagtcgatgagtaacgtgacgattgctttgattcccggtaattattcctggaatgctaagttgaaaccatcgaaagcgctggcacttgaaaagctcaaggaagattacaaagaagtctttgttgtcaagacgagtcaacgcaattctaagttcggcaaagctgtcaaagcggttctcaaaagtgctgcttttaagcaggcgattgcaaagtcggaatttaaggatttcgataaaccagcttcatggcaataggaggtcaagggcatgagtcagattgaattaaaacatattgatgtgacgtttcagcagaagaagcggacggtgcacgctgttaaggatgtctcactaaccatcgagaaaggtgaaatctttggaatcgtggggttgtcgggggcaggtaagtcaactttagtccgaacaatcaattatttgcaggcaccgagtcagggacaagtgatcgtagatggtcatgatttgaccaaagctaatgcgcgtcagattgcgtccgtgcggcgtaaaattggcttcatctttcaaaatttcaacctgatcggtaatcgaacggttgcacagaacctggcgtttgccctgacagcgggcggctatcctgaaaaagcgcagcctgcgcgtattcaagatttgctaacgttagtgggacttgcagatcgtcaagacaattacccggcacagttgtctggcggtcaaaaacaacgcgttggtattgcacgggcgctcgccaatgatccggatgtcttattgtgtgatgaagcgaccagtgcgttagatgttgaaacagccgaagaaatcattcagattctgaaagacatcaaccggcgacttcatattacgatcgtctttattacccatcaattggaagtggccagaagcttgtttgaccgggtcgctgtcatggaggcgggccaattagtggagcaatcgagcacgtatgacctgttcgcagcgccccagtccgatatggggcaacggcttgtcaaccggttcctagatacacaactgccgacaagagtcgctgcacagctcgcacgcgcagatggtcagttattagcattacgttatcgtggtagtgattcactaaccccgattattactgaaatcgccaaggcaacggatattgatattaacattattcagggacggatcgagtttattcaagaacgggccattggggtattagccgtttatttgacgggtaccactcaggccgttaagcaagcgattgcgctatttcagcgacgcgtcgattatgtggaggaggtgcaagtaaatgaatgaaacttggactatattacagcaaaatctcggaacagcattgtgggacacggctaaaatggtctttatctcaggctttatcggaatcgtctttggtaccattattggattaggactgtattactattctaatccgctatttgcctcgcacccgcttatcaacagtgtggccggttttattattaacgcgatccgctcgctgccatttttgattttaatggttgtcttgattccgttcgccaaattagtggctggtgatccctatacaccacttggtggcgcagtatcattgtcggtagccgctattccattctttgcccggctagccgaaggggcctttgccgaaatcgatgcgggcgttgttgaagcagcacgctcaactggtgcgagcttctggctgacttttcaggaagtcctatttcccgaagcattgccggcactcatccgtggcgttgttttgaccttgatcagtttgctaggctattcggccatggtcggaacgattggtgctggtggaattggggacttagcgattcaatacggctataaccgttataataccggtgtattagtcagtgtgattgtcattttaattgtgattgtgcaaattgttcagtggtgcggtgatcgacttgcggatcattacacgcgttcatagtcaggaaaggaagcataaacatgaagtatacggtattaggtgcgggagccatgggattacgttatggtgttttattacaagcagctggctatcaagttgattttgtcgatacttgggatcagcaggtccaaacaattcaacagcagggtggtgtctatgttgctcgtgatggtcaaaaccgccacttggttccgattcgaatcagcactcctgagaattaccatggtcaaccggatgttctgattattttcaccaaacaaatggggttgacagagattttgtcacgatcagcacacttcttcaatgaccagcaatacgtggttaccgctatgaatggtatgggccacattgaaaaaatcaatcaatacttcaagcctgagaaggtgttgggcgggacggccttgattgggacggtcttaaagcaagctggtgatgtcgactttatcggggcggcaaacgctggttcaatgaatattgcaaatcaaacggaacaacctgacgaaatgacccatcaaatcgttgccgaatttactaaagcacacctgaatccgactttgacgacgaactttttaggtaccttattggcaaaggtgatttttaattccgttatcaacacgttgtgcacgatgttccagattcaaatgggcgagtttattcagtcgccagtagctcaaaagttaggccggcaactgattgatgaagcgtttgacgtttgtgaacgggccgggatcacgttactgaatactcgagaagaagagtggcagacgattgaatacgttagtcgagagacgaatccgttgcactttccgtcaatgtatcaagatataacaaaacaccgacccactgaagttgattatatcaatggttatctctatgatttaggggtgcaataccactatgaagctaagacccatgattttttgcggaatcttgttcacttagccgaatttgctgggacgtttgatattacgagcctgaaaccattgacagaagggaagcactaattttgaaatttgaagagtccaaaattttgcagcaattaccaaaacagttttttgcgaatctggtcaaaaaggtcaatgccaaagcggcggccggtgcggatgtgattaatttaggtcaaggcaatcctgaccaaccaacccctgagtttgttgttaaagcaatgcagactgcaactgccaatcccgcggatcacaagtattcgttgtttcgaggtttgccgcgattcaaacaagccgcggctgatttttacgaacgcgagtacggtgtgagattagacccggagactgagattgcggttttgggtggcagtaagattgggttggtcgagttaccctttgccttactaaatccgggcgatacaatgattttacctgaccccggttacccagactatttatctggtattacgttggcacaggtgaagttggctttactacggttaacagcggacaatcatttcttaccggattatcagcaggttgatccacaagtggctgcggcggccaagctgttgtacctgaattacccgaataatcccactggtgctgttgcaacgtcgcagttttttcaagacacggtggattttgcaaatgaacatcagattggtatcgttcatgactttgcttatggtgcaattgggttcgatggtcagcgaccagtgagcttcctacagacaccgggggctaaagacgttggaattgagatgtacacgttatctaagtcctttaacatggcaggttggcgcgttggttttgccgctggtaatgctgacatgattgaagccttaaatttgattcaggatcatctgtttgtcagcgtctttccggccattcaagatgcagcgattgcagccttgaacagtgaccaacagacggtccacgaactggttagactgtatgaacgacgccgtaatcagttctttacggcagcccgcaagattgggtgggagccctacccatcagggggctcattttacgcttggatgccagtccctgaagggtataccagtgaagcatttgccgatttgctgttggataaagcggcggttgcggtggcgccaggcaacggctttggcgcgggtggcgaaggctatgtgcgcgttggcctcttgattgatgaaccccgcttcacggaagcctgtcagcgaattgcaaaactgcacttattcgatcgttaggatgacctcttagcattaatgatgacagtcagttacttgcttagcataattcatgcaacgggggcgcaactcgttcttgattgcttggaaatattgagctgtaataacggtatcaaaataacgcaactggcatgtgaatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgtcgtgatgtgaacgaggttattgaaagttgcggcttgtcgcaaaattgaatcaaaaagatcagttgtggcgtcaaataaccgttcgtcgtttaagacgggttgaacatttaactcatactggcgatttaattcaataaagccacgcatcgtttgtaaatagtcggactgggttgtcaccgattcaattagtgaacggcgacaaagagtgtagcccccaaattggcccgtcatatcgatcagattgagcaggacactatcagcgttcaatgcgttaatgaagccaacaaagaacatgtcagacccgtccgctgaccgaattgcaatcagttggtgctcatttaaggcgttgtttaaagtatgatcaacgtcgtcaaactcgctaactttgatggttgctcgatgcgtatggatggtcttgacaaaggcgctttccaataagagctcattgccgcagaactctaagatctgaatagcagccaatggaatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcggtttgggcttgggtgactaactgtgttaggactggccgttgatcgtctaaagctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaattctcaataattgaactcatcgtgtctaacccccttagttaatgttccctcatcatagcactttttgaggtgaagacgccattataagtcattattcagctggtttggtaagtgtgttatgactaggtaagtaaacggatgctcacgtgctattcaggtcgctcatctcattagaagggccttgttctgcaaatttaaaaccgttttcgcttgcacccggacgctgtcaccggcattgagtgcggctgtttggtatgtgtgcaacacaacacggtgctggtcatcgctacataaaaaatagtgttccgatgatgcgttcacagctagtgatcttaaagtgcaattcgatattcaaatgatgattgccaaaataaacgcatacggtttttttaaaacacaacaaatgtaagggctttctttacttgtgaaataggagtatcggtcaataagtatctattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattacttagtattcggggtcgcgttaaaacgtggcgatccgatgccaggaatcccgtatttaccatggatggttgtcgggattgcaccatggttatacatgaacaaaacgacgctggacgcgtcttctagcatttatcgtcaggttgggttagtttcaaagatgaaattcccagtcaacgtattaccgtcaattaaaatttatggtaacttatatagtttctggacgatgattgcttttggaatcttcctgatgttcgttaatggcatttggccctcagtttcttggattcaatttatctactactttggttgtatgatcgtattaatgtattcacttgggatttttaatgccacggtcagtgttctgattcgtgactggcatatcacgcttcaatccgtattgcggatgctgttctatatgagtggggtgctatttaactttacaacgtctaacttccccgcagtttttgtgcgcctactagaactaaatccgttctactacgtgctcaacggaatgcgggaatcgttgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatatcatttcgggaatcattcctcaaacgactgggacagtggatgtgcacggtgatacgtccattatttcaatcggagccggcttaaagtggaatttgaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactatcggttggtgatgacaccttctatcaaaaatgtgtggataagattatggaattcaagaagcaagggaagactattatctttgtcagccataatttacggcaagtagaattgctttgtgaccgggtcgcttggatgcactttggggatcttttagaagtcggcgagaccaaggaaactgttgatcattaccggaaattttctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcagtcttattcaatagtaagtgacggcggctggttagtggttgcattaaattaacattaatatcgatgggtgattgcgatggcaatcacccattttttgtgtgcattcaagacggctttggttggaataaagtacaatacaacgtcgcacattattcggactgggggccgctgatgcttttattcgaggggacgagcttgggctgaccgtactaccgatttgaaaggaaaatgtctaaacttcaatgcacaatttatgagttggtttcgggttaaattaagcttgattttttgtaatgcttcagcaatctagttatattcgttataagcattagattattttccgcctggaataccatttggtgggttatcttaatactagagcataaagggggtcatatcatggatacgccactattcttaaatgttgtcgcctatgtgctattaatattggtattacaatatatcaaattcaaatttccagacagtacctttatccgtttctttcaaaaatacgggtggtggttaattgggctatgttttgtcgcaatattggtgattttggccgcaccgcaatttcagaacccctttaatgcgttagatgtaccggctattggggtcatgttagtattcgggtacttctttattaaggataaaaaatcgaaacataagtgatgattaaatgagatagcacctcgaacgatgatgtcgtcctgagaggtgctatttttttgcctaaaaatcgatttgagaagcactgatgtttagccgttttaatctagcattaaacgtgaactgggttattcggtaacggaggggcataattaaaaaatcagtttggaaccttgcaatatatctaaaagatatatatacttaacagcgcgaaggattggtgaatttaatgtatgaattgtttattttaggacagttgatggatcatccgatgacgggctaccagttgcgtaaagcgctggtaaacgtagttggttcagaattaaccattagttttggtgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaataagcaaacgcagttaacgtttcaaataaagctgaattttttacatttattaagttgtgatcagcagcaagtaatcttgttggattttcagcaatttgcacggggacaggtcgcacgcttaacggcgcagcacaaacgggtgatgacgaatacccacatgcttgccgctgatattcaagatgcgttgatggtcaatgagttacaacgggtacgagcccaagcacaattagactggcttgaccgccagttgcgcaatggaggggaagttaagggatgaaaacaatgtcgtttgcgactgatccacaaattcaaaagcatcgctggtggatactggttgcggtatgtttatttacgttcatgtcaacgttagatgggagtattgtgaacattgccttgccagtcatgagtaaggatttagcgattccaatgaatcaggcggaatgggtcgtctcaatttatttgattgtgatttgtgcgttattgttattatttggtaaattaggtgatatttacggtaagattcgggtgtttaaaatcgggtccttactattcattattggctcattattgtcaggattcagtgtggggttgccatttctactaattgcacgcagtattcaagcagtcggagcggcaatgacgatgagtacgaacaacgggattattaccgaagttttcccgtttaaggaacggggccgggcgctaggtatgattggctcattcgttgcattggggagtattgctggccccggtatcggtggtttgatcctagctcatttgagctggggctatattttctggatcaacgttccggtgggaatcttggcgatgattttaggtgcaatgattttgccaaaagacgttacgacgacgcaacaaccattggataagaccggggcggggctatttgccgtactcatggttgcactatttgcaggtgtgtttatcgggcaacagattgggttcttgcagccggttatcttagccttgtttgcagtggcaattgtgacgctgattatttttgttcgcgtcgagttgcgccatgaaaatccgctgctagcgctacaattatttaagaatgcccgttttagcattagtgtcttatgtgcgttattaatttttattgcgaactttttctttaacgtgattgccccgttttatttagaaaatgctcgggggctagcggcaaactatgcgggctacgccttgatggtattcccaatcgtacaagtggtggtcgccccgattgctgggacgatttctgacaagatcggaccggaattgttaacgttcgtgggattggtcctgatttcaatcagtcaagtgggttacatggttgtggggctagcaacaccactttggttcttcttattattcgtcggattagttggatttggcaatggtatcttcatggcacctaataattcgatcgtgatgagttcagtggcggtcaaggacttgggcgttgctggcgggattaacgcgttggcacgtgaattaggcatgattgttggaatttcggttgccacgaccgtactatattcggcaatgagtcaatcagcggggtataaggttacgtcatacctgccagctcacccggagatctttattgatggtatgcacattgcgttcatggtctcgttagggatttgtttagttgcgacggtcattactggcgggcggttactaaaacatcgacgcacggcacctgccaagtaaacattagcaaatcaaaaaacgtgttgcgagaaatctgagatgatttcttgcgacacgtttttatattcttgcatccttgatgttgctgaaagggggtctggttaaatcagacttgttttaaagatccagggcataagctcactgaaaaaaactcggattagcgccgttatgacgccaaactcgtcgtttaattccctagttaggctaatcctcagtcttctcccgtctgatttatgcccgcttgtgatactgagcattgatagaaatgtgccatgcgactgctttctcgaacgcactgaaacctgtgcatattacgcccatgattccgattatcggaatcgttgttgcttatctagcagttgcgctaactgaccacgaaattcatcgctatggtgttgaatgttcgtcaagtcgtgactcatttgaacggtgtagtcagcgacttcgccgtgttcgccttgatcgagtccgagttcttcctcttgttcgtcaacgcgcattctgatgactcgtttcaatagtacgataatgacgatgcaaacgatggtagtaaagccaatggtaaagatcgttgctaatagctgtaatccgaataatttaaagccgccaccatagaaaagaccgtttagagaaattgtgttattaacggctttgctagcgaatagcccagtcatgatactgccgaccatgccggaaacaccgtggcatccaaaggcatcgagtgcatcatcgatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacaccgactagggttggtttgcccttggttagcatatcaacgaccatccacgtcatcatggaagtggcggtggcaacggtcgtggttaagaaggcttggatggcgatgtcgttcatggcaagcgccgaaccggcattgaaaccgtaccagccgatccataaaatagcggtccccagcaatacccataagatgttatagtgctgggtcatatccttgccatacttgtggcgggcacctaagaatgctgataagactaaagcggtgataccggcattgatgtggacgacggtaccaccagcgaaatcgatgacgccaagtttagctaataaaccgttatcccaaaccatatgaaccattggatagtagatgaggagtgaccagaagatgatgaaggttaataagaatttaaaacggatacggccgaccactgcgccaacaaatagtgctggcgtgataatggcaaacatcatttgaaagatgagatataaaccgttgggaatctttgtcgcggtaagcgcggtcaagtccacaccatgcaaccaagtggctttgagattaccgacaaagccacctaaatcaccggaaaaagatagtgaataaccgaatgcgagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagtgacgcactctttttttgtgtttaggttaaatattaaacttacaaacgggctttggtgtcattatggaactgctgatgtcaggttttgtgacgcaaaactattgaaaacatgagtgggctccttgtaaattcttagcaaaatccggtcaaggttgcttgttggcagaaatgtaggaagtgacttccaagagtggtcgcgattagttcggtaatgaaaataattaggcaatggggggcaagtgattaattatcttaaactaattaggggaattggtaactatagtgcgtgctattgcttaagaaaatgatgatatgaaaggtgaggcgctttcagcaattgaccattactaactagagcagtaagattatcaccacataaattaaaagacgatgagattattacataacgtcttaataattaaaacgggggttcagcttatgcgaaaatatgcgattattggggtcggccacgttggggcgaccattgcttatacattagtttgtaaaggaattgcggatgaattagtcttgattgatactaatgcggctaaagctcgcgcagagcaattagatttacaagacgctcaagcccgtttagatagtcgaacgattattaaaatcaatgactatcatgaattagacgacacggatattttatttgttactagtggcaacattcacgcgttagaccatgcttccggtaaccgatgggctgaatttgaatatacgaagcaaatcgttcaagatatcgctccgaaagttaaagcaaccaaatttaatggcgtggtcatcgatacaatgaatccgtgcgacgcaattactcactatttccaacgcgcaacgggattatcacgccaacaggtctttgggactgggactttcttggatacggcgcgcatgcaaaaggttgtcgcagaagccttcgactgtgatccaaaaaacattagcgggtatgtttacggtgaacacggcgaatcacaattcagcgcgtggtcaacggttcaggttaacggtattccaattacatccttagttgataagtatgatttggacttagatgcatttgaggcagctgcacgccatggtggctgggcggttcattctggtaaggggtataccagttttgccattgctacttgcgcggttaaattaagtgaagcggtctttgcaaatgctcgcttagcatgcccggtctctgcgtatagtgagacctttgggacgtatgttggtcagccagcaatcattggcaaagatggggtcgagagtgtgacgacgcttgctctgactgctgatgaacaagctaagttccgtaattcagcggacacaattatcgagaaattccacgcctttgatgacgtcttaagcgatcaatcagtaaaaaaacgtcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttcgtgattgtaatcgcgacgattctgggagtaggctgtgccttgcttggtcaatggggccagttcttcggagtcatcgcagcaacgtttgcgctaatgttgttaaccagtggctgtttgactttttgtcatcgccgcgggtggcaacctggaagcggcatgttgctagcattagtcacggctacagggtatgtactagttattttaggaagctatggttatttactgcacagctaagcgcagcactttgatacgaggaatcgaccgtatcaaagtgctttttatctgcaatcatttttagcgtgctaattaagttatgtttcaacaatgattacggccatcggtgctcatacaaaaggtcgcgactcatcatcgcggccttcctgggtgcggtattgattgtaaacatcaaagtggggtcaccgcacccaaggtattaatggcagacctagttggatagctttacctaaagcctgccaacaggtaagcggtaacgcagacgcaccgccgcgctatcggctgcactaataccgttatagcgattatcagctaacatgacactgtggcgatcacggctgtgttccaaaccaatagtatgtcctaactcgtgttcagccacgtggacttgatccgtataagaatagtggtagcgtacaaaattacgtgttaacaagtacacttgcgcttttgtgtaataaccattggtataaccggtcgaaaaagtaataccagctaagcgataatactgcccactggtggcattactggtccccaaagtaatttgatgatgagcagtggttcccggcacgaatttaaagtgaccagtcgcattccaggcttggatggccgcttgatagacgtgccgctcgtatgatgatgcttgaatgacgtaggtcacttgagcgtgtggccaacgactccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgttgagataggagccccatcctagactcaaatttgacctagaatcgcatggtttgatcgcgattaaagttagttaaataggttatcgcgtgctatgatgagaatatcttatgatgatggaaggaaattgatatgacgattaaacaggcaattgttcaacaagccttgacgttaataaaaccgcaaatggttgttggttttgggggtggctcgacggttggtgaactggtcaaggaggcagccaatcatgtgaatgatattacggtcgtcaccccatcaccgacgacccgccaacttgcgaccgttctcgggtataccgttgtagatactgcatattgtgaccgcatcgatattgcttttgacggctgcgatcagttagatcatcacggtaacgcgctcaaaagtggcggtggaatccatgctaatgagaagattattgccagcttggcggatgaatattggctgttaacgatgcaggaccggttagtcgatcaatttgatatcaagacgccattagtcttagaagtactaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaaacttacggacctgaatgttgaattggcaactttggctggcgttgttgaaacgagctattttgatcatttggtgacgaatgcttggttgggcgatgcaaccacgaatacagtcaacgcgctattttaagtgttatcagggacgacagcatgaccctaatgattagcaattgagcactgaaattcgtttgacacttttttaaaataattctaaactgaaggtgacgtataaaagcgccaccattttttgaatctaagttattttaaatatctaaggggatgtcaacatggcaaaaaaagtctatactgattatttttttgatgaacctgcttacaacacacatgacggtggctatattccactagttacaccgaaagtcgagccacaaccgttagcgattccgccgttattgaagccggaccgccagacggatacggatgattactataccgtcacggcgcaagaaagcgaaactcagtttttacctggtaagaagactaaaacgtggggctataatgcgggcttcctaggccaaactatcgtctttcgtaatggtaagcagacccatattgacttggaaaataaactcccagaattgacgactttccattggcacggcttgaatgtcccagggcccattaccgatggtggctgccacgcaccggtctatcccggtgaaacgaatcacattgactttaaagtacatcaaccagctgcgactacgtggttacatgctcatccgtgcccatcgactgcgacgcaggtctggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactacgatccagatggtgttcaagggcatacggcgttagttaacgggacggtcaacccatattttgatgtgacgacgcagcgggtgcggctacgaatcttggatgggtcgaaccggcgcgaatggcgtctgcacttcaatgacgatttggaatttgcacaggtcgcttccgatggtggcattttgccggcaccggtttatatgaccaaagtgatgatgacctgtgcggaacgggacgaaattgtcgttgatttcggtcagtatcagccgggcgatgaagtcacgctgatgacggatgatacgccgctatgtcgcttccgaatcaagtcgttcgtaccggatgacaccaaactaccagaacatttagttgatattcctgatgaaaccccaacacctgacttacctgttcgcacaatcacgatggatgggatggatgatgaagtcgcgcttgatggtaagaaattcgatatgagtcgcatcgacgctcggcaaaaagttggggatgtcgccatttgggaaatccgcaacaccaacagtactgaaaacggcatggttcatccattccacgttcatgggactcagtttagagttttggcacggaatgatggtccagtttatcctaatgaacatgggctgaaggatacggtcggtgtcaaccctggtgaaacggtgcggatcaaggtcaaatttgagctgacaggagtttacatgtatcactgccatatcatcgaacatgaagatggtggtatgatggcccaaattgaatcatatgatccccaacacccacaaacttatcatttaatggatatggacaccttacggaatgcttttgcgaaggaacaaggcatcaagcccgaagatgtttggatgcccggtatgtaagtgtagattaagctaatttagtgatgagatgtgaataaagtccggttgcaaccagcaagttatctgcttggtcgtagccgggctttatcatttaaaagcacctcggggtcaaaacggtggcggttttgaccccggatttaccatgttttaatcatgatttgtgacgaattagctcgtataaagacaagtaagtctgtatttctacagtttaggcgcagtaactggtacaattcaagtaaggaccgaaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttgtttgtgattccggccgtcgcgagcgccggtgcaaccctgtttttcttagcctgtgtgatggttgccgcggtttatggtagtattactgtcagtcgcgcgatcgtcgtgattcaggggctaccggcattaattgcgtttattctgatgtattttgcttagccggttctttgaagtaatgccattatattagtgttaataaaaaacgttgctacgtgattctgtagcaacgtttttggttgtttaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgagtcgtggttgccggtaaattggcggcaatccaatgaatccaggtgaagccacctactggaatcgcatcgtggtcaacgaaagtgaacgccagtgaatgggtgccagctggcacatcactaatgtcaacgggaaacgagatgatggggtggcccttatacgtttgggcaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacgcagatcgcctaagtctgtccggtttttgaacgcttcttgatcttcatagcgttcagggcgaacgacaatccgatcatggtcttcatcatagcccacagaagggccgagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagctcgcgtgcgggtactggtctaaaaatggcttgagatcgttgatgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcgataaaaacaacgtctgcttgccggtggtcttttgccaaccggttgatcaacggagtgggcttttggaagtcttttttgcgcaagacgggatcttcaccagctaagcgcttataaattttgagcatttcattgtgattgacgacgagatagttgtcagtggcctgcaaatcgtttggtgtcaagctacgattgagggcttgtagccgagcaaacgcggcggctaatacggcactcttgccagttcctgcatcaccatgaataacaaagaggctgggctgtttttgctggcgatgggtacggataaaagttaatagttggtgctctaatgattgttgtgccggtgacaacgcagcttgatcatttagcttgaacgttgcggcactgattgtagatgacatattttttcactcccaaacacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtcgctagtcgggaactcgcgcagtcactgcatcttaacccggtgatgattcgcaatattttatcagttctacataagcatggatatttaacggggacggttggtaaaaatgggggctaccaattagacttggcgttggccgatatgaacctcggcgatctatatgatttgaccatccccccaacaattagctatgcgcgcttcattacgggaccatccaaaacggatgaacaggctgatcaatccccaattgcggccaatattagtgaaacgttgacggatttatttacagtagctgaccgtcaatatcgggcttactatcatcagtttacaatggctgatttacaagccgacctgaaccaccacggcacgtttttacgacacgaacaagattcagaatcttaagtaaaaagcgtcacttgattgaaaaataaggcgattttcgttaataaccttaatttgaaacgggtttgccattcaggattgtcagggctaattatcggtgctatcttagatgtcattatgaaagtggcattgagattgaaaggggccttggcaatgacagcacggttagtgttaattcatgaagttggtcgttatcgagaattatcggaacaacggtactggttagaatccgccgatttttggggtgtcgatgggcgtggcgcgacggtcaatgaggccgtcggtaactttttgaccaacctcgtgcaatattgccgcgactattaccaacgcggcttgtggcaacttgatgatcggttgttacagctagaccacgttgatacagtgttagcgtacgcgcaggcaggtaagtcaccagcaccattatttttgtttaaattagttccggcggatcatgagttggcgtctgcttaaacgaaatattgacgaattcttaaagaagcgttcatacttccaccacactcctgcgctaaactatgcgttataatcaaagcgtaaattaattggagggtgttgtatggaattagataagatttatcagttaatggacaagtttgaacaaagcagtttaactagttttgagtatcgggaccaagattttgaaattcaaatgggtaagaagggacacggcaagacgacggtgaccccgcagccggcgccacttcccaatcagccggtgattgacccaacgccggtcacaccgacaccggtctcaacagttagtaccccagttgttgcggaggcggaaccaaccccagtggcgaccagtacggctagcaatccgacgagcgttgtaacacctgatcctgaaccagaaccagcgccgattgatcctaaggaatgcgtgacggcaccggtcgtcggaatctattacccagcgcattcttcagaagaagcgccatacgttaagttaggcgaccacgttagcgttggtcaacaagtcggcctcattcaagcgatgcagatgatgcggccggtggttgctaagcaagcggggacggtcaaagccttcctagtgaagaatggtgaagaagtcaacttcggtcaaccattgattcaattaatcccagatacgccggatgacatttaatcaggtacggtcagtggttgctgagcgtattaagcactttgagtagcactacgtcttgataaaagcgtgacgcaaactaaaaatgaaccacttcaagcgcacatgataattgtgcaagctgaagtggttcattttttagcttaattaatgacgattggtagtgatttatttaggttggtcgatggctgccacggtttctaggaaccacttgttgaaagcagccgcatcaatatcgacacaaacggtcgcgttggttttgccgtcatggtaagcaccacgaatatcgccaacggtctcgccattagcggggccctccgtctggacatcaatccacatcctttcagtcgtaaaggcttctggatgtagtaagtagaagagcgtattgacatcatgcatcgcaacgccagtctggttgcggtcgttgtaatgaccaaagagggcgtgaagcatttcgccagtttttccgagggtcggtaactgttcaatcgattcgcgcgttaaaagggccttcatcgtcacgtctaagccgaccatggtaattggaacgccggattggtacatgatttcagccgcgtgcggatcggtaaagacgttgaactctgcggcgctggtcatattacccttgcctaaggccccacccatcgcaacgatttctttaatgtgtggcattacttcggggtaggtcttaaataagagcgcgatgttggtataggctcccgttggcactaacgtaatcggttgttcagcagccatgatgtagtcacggagcgcttcaacggctgtttctggtaatggttccgcaaggtcagtcgggaagtcgtaacccggcattcctgaaacaccgtgaattcggacggcatcttcaaacggtttgatcagcggttgggcagccccacccgctacgggaacgtcactgttaaagaagcgcgttagtttgagcgcattcagcgtcgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacaggtcatcttaattacgggcgcatcttcggggatcggtaaagcaactgctttgaagttacaagctcaggggaacattgtgtacggagccgcacggcggattgaaaaaatgacggatttagcagcggctggagtgcacgttttaaaagtcgacgtgacggatgaagcgacgttaatcgcggctgtcaagacgattcaggtcgaacaggggcgcattgatgtcctaatcaacaatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcggatcattaatgtttcttcaattgggggtaagatctatcagcctttaagtgcttggtatatggggaccaaacacgcaattgaagggatgagcgattcgttacggatggaagtcgcaccatttggtatagatgttgtcatcgttgaacctggtggaatcaagactgaatgggctggtattgcggaaaaaaaagctgttggcagtttccggtgaaacagcctatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcgggggtctcattaacggctcgtcagtggttgagtgatcgtcagtttgaccgcatgatgaactcagccgtcaatggtgcggctaagctgtcaaaagttacgcggcgtaaggaccggcgaaccgggagtcggcattatcggcatggaaaaatacccgctaataataattaatctgaataatgatgctaagaagcgagcccaacgatcacagttgttattgtggtaggggttcgcttctttatttcaggtctaagctttaagcttcccccatgtagcatgggagagatagggtctcgttagttattattttagatggtgcttggatgatgacaagcaggtggattcttgttcggcagcaatgatcgtcctattccgacctccggggctgggtgacaattgccggaacgtaagccgacatcgatttgagcccgtgcacaaacccgcccggtctcaaatacgagtcttattctaagccggaagtagcccacttccgactaagaataatttggctactgagcattgtcacccagcccctccggtcggtaagccgctcgaatggctgatgaacggccacttaacttggtataattggtcgctgactattttgataatggagccttaaacgagaggttaggattacattaaccactttgttgaaacgtttgattattactatggtgattccgaaatagtaagctatcacaatgttactttctgcctgacagttgctcgacaaaattactgtttatgaagaacaatgatgagtccaataaaagttgggtgcctcaccgtcagccattcgaatactatcccgactggaaggcgtttctgacaatgcccagtggtgaaatttcacttagcaagcgtcttgtgcttggttagtgaaaggccagtatttgagacgtggtgtttcggcttaaatctgtgcccaccacgttccggcaattggcagaaatgcctggaagtcagtgtaggacgaactaaccaaacatgtttacgctaacccgaacttttccagcgggcctaagctggctgctttggacttaggtttgcaccgccattatagcttcgtcatcaccgccgttagcgtagtcgttgcggtggtcatcacgggatcgtccacggggtggtaggtgatggtgaggttgggaaattcttcgataatgggaatcagcgtttgccattggggtaggtctggttggtcggcttcgggaacgtcccagttgttttgccgccagcttaaataacgttgttcgctaataaccgccgccacttgttcagttgtggtgtgaatatgaacgggtaaatcatgacgtttcaacgtggcgagtgcggtggtcagagcactcaaggccagtgaagtttcggtatgtccgtagccaccgtcgtttagcgccttttgatggtcagcgtatcgcagaatgacgacccaggcagcgggggtcgttgcggtgatgttggtcgattggtggttggtacttgcaaggtaaagatgaatcgtagccattgttggggcctccttagttgtaatgataatccattgagtggttcatctaatagtttcgtaaaaactagccagcttcattttaaattaatgaataattttaacgtgaaactacaatagttacaaaatttggtgaattgccggtgcgtattactatgatttttggcggattatgctacgattaaatacatggataattaagaagttattaagtaataaaggtgagcactggaggttagcatgcagacattaatacagacgtttatggatcgacgcggggatttgctgactgcgctatggcaacacttggggatttcattagcatcattagtcatcgcaatggtaattgcgattccgttggctatttgggtcgttcgacgaccacggtgggccgagggattgttacagctcacgagtgtcttacagacgattccgtctttggcactgttagggttattgattccgttagttgggattggaacggtgccagcagtaattgcgctggtgatctatgctttactgccaatttttcaaaatacttatttgggtatctcagaaattgacgcctcaattgaagaggccgccgatgcctttgggatgtcacgaatgcgtaagttgtttaaagttgaactacccattgccctaccacagaccattgctgggattcggaccgcgctcgtcttaattattgggacggctactttggccgctttgattggtgctgggggtctcgggacctttatcatgctcggtattgaccgtaatgatacctcgttattattgattggggccatctcatcagcattgttagcaattctgctgagtgcgctcgttcggtggtttcaaacggctaaaccacgccacgccttaatcgtctttgtcggtattttagctttacttggtggtggcggggcttatagtgtctatgccaatcgagttgaaacaattacgattgcaggtaaacttggttccgaaccagaaatcttgattaatatgtataagcagctgattgaagctgaagatgagcatgttcatgtgacgctcaagcctaactttggcaagaccacgttcttattcagcgcgttaaagaataatcaggttgatatttatcctgaatttactggctcggtgctggagaccttagttaagggaaataacccagctggtcaaacagctaaccagacctatcagctcgccaaacagcgcctcgctaaacaggaacaaatgacttacttgaagccgatgcagtataacaatacgtacgcattagcagtgactaagaaatttcaacaagaacatcatttgaagacaatcagcgacttaacgcaggttgaatcgattctgaaacccggaatgaccctagagtttattgatcgtaatgatggcttaaaaggaatcaagaagacttatgggttagacgtgactgccaagtcgatggagccggcgctacgttatgaagccatcagtaaggggaaaatcaacttggtagatgcctatgcgacggatagtgaattacggcagtatcacttggccttattgaaggataacaagcacttcttcccaacgtatcaaggggcaccgttgatgaagacgagctttgccaacaaacatcctaaggtcgttaaagcgttaaataagttagcaggaaagatttcagaaactgatatgcaagaaatgaactatgaagtcaatgttaagaagcagtccgcttcgacggttgcacatcgctatcttgtgaagcacggtttattgaaggagggacgttaaatgacaacggcaattgaatttcaacacgtccagaaagactttaatgggcagaccgtgattcccgaccttaatttaacgattgaccagggtgagctatttgttttggtagggacttctgggagtggcaaaacgacgtcacttaaaatgatcaactgcttagagccattgacggctggtaaaatcctagttaatggtactgatacaaccacgataccagtccgaagtctacggtggcaaatggggtatgtcttacagcaaattgccttgttcccaacgatgacggtggcgcaaaatatcgccgtgattccagaaatgaaagggacagctaagaaggaaattaatcaaacgattgatgagctattggcggaagttggcctcgatccaaaggaataccgtgaccggatgccgtcagaattatccggtggtgagcagcaacgcatcggtatcttacgggcgattgcggcgcaaccagatattgttttgatggatgaaccatttagtgcgttagaccccatctcgcggcaacaattgcaagacttggtcttacggctacacgcccgctatcacaacacgatcgtcttcgtgacgcatgatatgaatgaggcgttgaagttgggtgatcggatcggtgtcatgcaacacggtcagttaatacaagtcgatacgccggctgctctggctcagcatccagtgaacgactttgtgcggaacttctttggtgcgagccgagctaaaaatgtctatgatgtctacgttgggcgtgtagggcttattcagggttatctcacagaagaacccagtgttgcgagtggtcggattcaatcgttagacgttcaagccacgttacgcaccgcctttacggcattgacagatcacgattatgtggcggtcacggaagaaaatcgagttgttggctatttggatcgccaacgaatcgtggcttacttgagtcaacatgaagaagtatcttaatcgtcaattaaggataaatcagttacactaggttgtgataattgatggtcgctaatgaatttaaggaggaatttcgaatggcggaacagtacgatgttgttgtgattggtggcggaccagccggcaatgccatggctagcggattaaaggctcagggcaagacagtgttgatcgttgaagcggatctgtggggcggcacttgtcctaaccgcggttgtgaccctaagaaaatcctgttaagcgccgtcgaagcgcgacaagcggcgcaacatttacaagggcagggcctgattggcgcgcccaaaattgattggccagcactgatggcgcataaacgaggctatacggatggcatcaacgatgggacgttgaacggactaacggggcaagatattgcgacgttacatggccaagcacactttcaatccgacaatcagttagcggtcggggatcgagtagtcagtgcgactgattacgtgattgctactggtcagcgtccagcgattctaccgattaccgggcacgaatactttaagacgagcactgacttcttagatttggaccagatgcctaaacgcgtgacattcgtaggtggtggctacgtaggatttgaattggcgacgattgcgaatgccgctggcgctgatgtgcacgtgattcatcataatgaccgcccgttaaaagcttttgatgcagatttggttaaggatttgatggccgcaatgacggctgatggaatcacgtttgacttgaatacggatgtccaagcaattactaaaacggcgaccggtctacaattgacagctgataatttcgagctgacaacggatctggtcatcagctcagcgggacggattccgaacgcggaccagttaggtctagccaacgtgggcgttacctttgatcggcatgggattcaagtcaatgatcatttgcagacggccaacccgcacatttatgccattggggatgtcagcgatacaccggtaccgaagttaacgccagttgcaggttttgaagcgcgttatctggtcggtgagttgacgcatcccggcgcagccataaagtatcccgttgtgccaacgcaggtttttgcagcgcccaagttagcgcaagtcgggatcagcgcggccgcggcgactgagcatccagatgagtatcgtgtcaatacacttgatatgacgaagtggttcacttattaccgctttggcgcacaacaagcccaagctaaagtagtggttgctaaagcgagtgggcaggttgtgggtgctacccttctaagtgatgttgccgacgagatgattaactacttcacgttgttaattgaaaaacacgtgactttaccagatttacaacggttggtattggcttacccaacgccggctagtgacttacaatatttgtattaatgtgtggttgaattaaatcaaagtccagctattcagcttaactgaatatgtcagcactaacggagtgaccaggaatgaccggccactctttttttgtttgaccggcgtttggagtggaatacgaaggccaaatgatgtcgcaaacagacggtcgtcattttcgttgtgcgactatcttggcgtgtaagtactgtgaaaaaatgtcaaaattgtagctcgtcgcggtggcactaatgttagtaaattaattattttatagaactagaagcgattgcttaaatgctacgatgcttgctatggcagtatcgaactgtgacatagtacaaactagttttaaagtaaattcaattgtgcaaaatttaatttatgcaaatctattcacaaaacggtcgcgacatggtatgattcaatcatcaattatgatagcgttttcataaaactgttatgactaaggagtgacacaccatgaccgacaagtacattatggcaattgacgaagggacaaccagtacccgcgccattatctttgaccatgcgggccataaagtggccgactcacaacgggaatttccacagtatttcccgcagccgggctgggtcgaacataatgccaatgaaatctggaatgctgtcttgtctactattgcgaatgccttcattgaatcgggaatcaaacccgctcaaattagtggtattggaattacgaatcaacgggaaacaaccatcgtttgggacaagcaaactggcttgccaatctataacgcaatcgtgtggcaatcacggcaaaccgcgccgattgctgagaagctggttaaagatggctatggtgatttgattcatcaacatacgggactcgtcacagacgcttacttctcggcaactaaaattcgctggatcttagaccacgtgaagggggcccaagaacgagccgaaaagggtgaattactctttggaacgatcgatacgtggctcctatggaaacttaccggtggggccacccacgtgacggattattccaatgccagtcggacgatgctcttcaatattcatgatttgaagtgggacgaccagattttgcaattattaaatattccagcggcgatgttgccagaagttcgcactaattctgaagtttatggcaagaccaaggactatcatttctttgggtcggaagttccaattagtgggatggctggtgatcaacaagcggccttgtttggtcaactggcgtttgaaccgggaaccgtgaagaatacttacgggactggggcttttatcgtgatgaacaccggtgaaaaaccccaattatccgataataatctattgaccacgatcggttacggcatcaacggtaaagtgtactacgccttggaagggtcaattttcgttgccggttcagcgattcagtggttgcgtgatgggattcgcctagttgaaagcgctcccgattctgaacgggcggcgcgcgaatcgcataatgaaaatgaagtctatgtggttccggcctttactggtttaggggcaccatattgggactctgaagcacgtggctcagtctttggcttgacgcgtggcacgactcgtgaagattttattaaagcaaccttgcaagcattggcttaccaaacgcgggacgtggttgaaacaatgaagaaagattccggtattgagattccagtattaaaagttgacggtggcgctgctcgtaatgactggttgatgcaatttcaggcggatatcttggatacgcaaattatgcgggctgctaatctggaaacgacagcgcttggtgccgccttcttggccgggcttagcgttggttattggcaggatttggaagaattaaaagcgtcatataagcccggcacgagttttgaccctgagatggggccagctgaacggacgaacttatacgagggatggcaggcagcggttaaagcgacccaagtctttaagcacaccccataccacgcaggaaaatagaggaggacaacaacatggcattttcagcaacgacgcgtcaacaaaatattgaacgcttacaaaatgaaacgttagatttactcgttatcggtggtgggattaccggtgccggtgtcgccattcaatcaaccgcaatgaacatgaagaccgggttgatcgatatgcaagactttgcagaagggacttcatcacggtcgacgaaactggtccatgggggcattcgctacttaaagacatttgacgtgggggtagtcgccgataccgttaaagaacgggcggtcgtccaggggattgcgccacacattcctaagcccgacccaatgttattaccgatttatgatgagacgggagcgaccttcgacctcttttctgttaaagtggcgatggatctgtatgataagctcgccgaagttaaagatcctaaattcaccaattataccctttcacgcgaggaagtcttacaacgggaaccacagctgaaccctaaacatttagttggtggcggtgtttaccttgattttcggaataatgatgcgcgcctagtgattgaaaacattaagaaggctcacgaaaatggtgggattatggcaagccatgtgaaggcgaccggcctcttacatgatgatgatggccggatcaatggtatcaccgctgaagacttattgactggtgcatcgttcgagattcatgcccgaatcgtcatcaatacgaccggtccatggtcagacacgattcgtaagatggaccatactgaaaagtatcaatcccagatgcggccaaccaagggtgtacatttagtcgttgatgctgagaaactcccagtgccacaaccaacctattttgattctggtgatcaagatggccggatgattttcgtggtgccacgtgaaaacaagacgtatttcggaacgactgatacggattatcatggtgatctgaaacacccgaccgttacgcaagaagatgttgattacttgttggaaatcgtcaaccgtcgttttccaactgccaaaatcaccttagatgatattgaggctagttgggccggattgcggccactgatcgccgctaacggtagttccgattataacggtggtaattcagggaaaatcagtgataagagcttcaaggaagttatcaaggttgttgatcagtttgaaagtcaggaagccagtcgtgaagatgtcgaaagtgtcctgaatgacttggaaacttccttggcagaggacaaactcagtccgtcagcggtttcacgcggtagttcgttgactagtagtccagacgggctgttgacccttgctggtgggaagattactgattaccgtaaaatggctgcgggtgccatggcgctgattgccaagattttagcagataagtatgacgcccactttaatgaaatcaattcgaagaacctccccgtttctggtggcgatattgatccgcacaacgtggatgcaacgattgcattttatgctaaacaagggacggataatggtttgacgaatgatgaagcgttgcggattgcaaatatgtacggttccaatgctgcgcgggtctttagtttgattggtaaagttgaaccgacgcatggtctgagtttagccgaaacgattagcttacgttatgctttggatgaagaaatgaccctgacgccagtcgactacttgctgcggcgcactaaccacttgttattcatgcgagatacgctggatagcttaaaggatggcgtcatagcgacaatggccgattaccttggttgggatactgcaacggtcaaagcacaaaccgaattattgaatcagacgattgctgaatcggacttaacagcactgaagcagggctaaggaatggggtggtcatgatgaaagatccattagcactacaattgttgggggaatttctcgggacctttatcttgattctgttaggtgatggggttgtagctggggtaacactcaataaatccaaagcgcaaaatgcgggttgggtcgcgattaccttaggttggggatttgcagtcacgatgggcgtctatgcgtccagctttatgagccccgcacatcttaatccggcggtctcactaggaatggcagtggccggtaagttcccatgggcctacgtgattccatatagtgcggctcagattgctggtggggtgattggtggcctcgtggtttggttgcactactacccacactggcaagcaactaaggatgctggcgcgattctcggcatttttgcaaccggtcctggtatccggcggtatttctggaactttatcagtgaagtgattggaacgttcgtcctagtttttggcttgttagccttcacgaaaggccaatttacggcgggattgaacccgattgttgtcggaattctgattatcgctatcgggctgtctctgggtggaacgaccgggtatgcaattaacccggcccgggatttagggccccgcattgcgcacgcggtattgcccatcgccaataaaggaacttctgattgggcctacagttgggtgccaatcgctggaccattggttggtggtgcgttaggcgcactgttgtttaatgtattgccataattttatgactgatttgatataaaccgtgaggactgttggaattgacaacagtcctcacggttttatttgtgagtaatgggtgaaatgaatgctttcattaactgagcaaaagacatctgctaattaaaattttatggtttggcaacatataaaatacctttcagttgggtagtcttcgattagcagaaaaaaggcttaatatttgatagactaggtgctattttgcattaattatgattaaaacgtaccaatttagttgaattactgattatcagtaaatgcggaccttattctaaaccggaagaaagccatagctaaataagcaagtttatacaaaattgtacttttccaactgatctaagctgattgctcttgtgcttagtatggcaagctttaaccatggtttagggtagaaaaatcagcatgatacgtaaagaatttatacaattgaaaatgtcaatgtatattgatattaatataaaaatatttattgttttttaacaaaatacatgttaacctgctatgagtagttagttagttgggtcgctttactatataagtgatagttagataaaaggggttaaacatgtatacggaaaacacggggaaacatcatcgtaatggcctgccagtttggttgttgccattactggtcgtcatctctttctggggtgtgtcacaaaatatcatggtggttgatgcttcatcatcggtcacggtcttaccaggcaacgggggcacgctcccactggtcaatcagctagtcatcaagcaaaatgacacggccttacaaggaatcacgaataatgctggagatcgtggcagtctaacacctaagaacggtgcgcaacgtgtgctcatacataaggtgaaagacagtgatacgattacttcaacctatgggacagtgggaactttccatggtcaggaagtcactgctaaagtaacaatctcacatattaaagttcacgacgacagccacaaggcaccgtcgggaatgaaacagactgacggggcgtttcaaattggtccgggcttttcttcggacacgaccatgtcaaatgtggcccaattcaatgtgagctatgaattttattacgctgatacgcatgccgcggtcaatattcaaaacgcgttcattacgctatctagtctggatggtccggtagcggggacgtcaaccggctttgaatatacggcttacttaggggctggtaagatttatactgttgaaaactcgattgttaagcaaattgcgaatcccctcggtggaggacaactcgtcatggctgggcaaacagcgcgtgatgcgagctggccatatacctcgtcaacggctgcaacttttggggtcagtgggacgaagctggaatttatctacgggacgacccgtgttaatagtggtaattcatggttacaaccagtctacaacgttagtacgatcacgctggggacgcccgccattgcgacgcccactttgagtgccacacaaagtgccactgacaagcaaaaccggacgttaacgtatgacttacaacaaaaagtcaatgttttggatcaggatttaatgaccaagtataaagattggtcagaaaatattacgattccggctaacgctaagtacgctaaaggcgaagtcgttaatgatgctggccaagcattacctagtactgcctaccaagtcagctatgatgaaaaaacacatcaagtgaaatggcatctgacggacgcgggcattaaatcgctaccgtttaaaggtgagacctatcactttaaggctcaagtccagttcagtgatgatgttgatgaccaggccaaagtaacggcaactggtcaaacggcaatagataagcagattaagacgtcgaataccgtcaccaataccattgacaatcaagcgaccatcacggtacatcattacatgaccgattctactgataaggttgctcctgatgaaacagtcaaagttggttacgggaaagcttatgatgttactaagcaggtcaaaacgataactggatataagcgtaatgccacattggatgaacatacccgtggcactgctagcaagactaccaaagaagccgtgatgtattatgatccgttgccatacaacattcatgtcaattacttgttaacggatgggcagaagctggacgaattggatgtcactggtctatatggtgatacttacacgaccgaggcaactgatttcgaagatttgtacacagttgatactgatcgcttaccgacgaatgcccagggaacggtaacggaaaagccaacaacggtcaattattattaccaaccaacgactgggcagtgggttgacgttggtaatcaaagtagtgttttagtacgacaagatacgaagcataatgtccgttctgtctcgcagatttatgccaacgatagtggttttacggtcaaatataatcaggatgcggctcaagttgcgattgcggctagtgatacgaacggtacccaagataacagcttagtctttgattataattcgaagtatacgtttgaattatctaagaatgagactgtcacttttaaggttgatgatcaaggccaagtgactgcgactagagtgttaggcgcagagcaaacggtcacgacttttgataaaagtggtcagctcaagacagtgaccacggtgactaacgcgaatggcactaagagccagcagaccaacacggttgacgggttgaaatcaatggtgactggcgaacaatacgacttaggattattgaatgggttgaaagttaccgcacaaaaagaaattaatccgagtcaagcagcaacgactgagtccaagacaacgactgatactagtcagtctggtagtaatcagtcgacaagtacgacagcgactgaccaaactgggactaatgaatcaactgctggtagttcgaccaacgcaacgaacgcgtccagtagtgtcgatgcaagttcagcgaatagtcaaggtgacactgaggctacaagccagtcgggtactagtgcaagtgctgattcaaagacggatagtagtgtggcatcaagcactagtcaaactactgacggtgaaacaaccaataccggtgatacgaccactggaacaactactggcagtgggctgggtttcaagtcaccatttactgaggatcaaaacacaagtagtgcactaggcagcgctcaaacttcgagcagtctcaatagtgatacgagtgcagcggtacaagcattgattgcagaacccaattcgacgccagttgtcttggatgaggatgcttcttttgaggaaggcgtgccagtcaatgatccggtattcagtaatgatgaaggtgtttcgccgaacaataatccaagcagcgcggcgacgccccttgcgcaagccacgaatacccgggcgcgtctgactcaaaatggcaaactattatatgaaggaacgctgaaggctgatcaaggggaacaaaatctctatgtgtcgccagatacaactgtagaagttgatggtggggccgatggtgacggtttttacctagatacttatgatggtgataaaggaatggcctatacattgggttcaggttatgcgtgggcagccgaaaacaatgatgtgactgcggcaccagcaagtagtgcgacgaccagctctgagagtgctgctagtgagccgagcgttaatagtagtgatagtagccgtacagcatcaagtgcagtcgaccattcgactagttcggcaagtaccagtgatgcgagccaatcaagtcattcaactagctcgggtgaaagtagtcatccagaaagttcatcaggctcaagtacgaccagtgattcggctgacgtggataaacaggccgcagctcgttccagccaaactcagtcgaatagtgttaatggtagcagtcaagcagtgagctctagcacggtcactagtcaatcgtcagtaccaactaaagctaatacgaagcaggcttcatccacgccaacgaccaaggctaaccgagcaactgtcgcagccgctaccagttctacagcgccacggcagtcgcgggctacgacggcaagtgcgtcagttccaagtgtaacctcagcaagtgctgcagcggcaagtcgtgataagcaacgatcggcgttcaagaagcaacatccaatcttgaaccaaattttgcctaaaacgaactccgcggtcgcgacctggttggtctggctaggagtgggtttgttgctactcactgtagcgattacgatggttattaagaaacgagggcgtgactaatatgataaaattacgccaggttcttaaaaaaatcctcattggcctaatggtgtttgttctagttttcacggctttttccagctcggtcgacacagtctccgcacatcgccgtggtgtgacccacactcggaagcataaggtgcgacatagcgctagtggtcacgccaagaagtctcatcgtgcacatcgcaaagctaagcgcagagtcgtccaccgtaaagcaccgcatcggcggaaagttgcggtaaggcataagaaaaaaacgccaaagcgtcataaaaagtcgcataagaagaaggccgctaagaaacataagaaggcccataaaaagaaagcggtcaagaagcacaaaaagtcacacaagaagaaagcggccaagaaacataagaagtcgcacaagaagaaagcggccaagaaacataagaagtcgcacaagaagaaagcggccaagaaacataagaagccgcacaagaagaaagcggccaagaagcatggcaagtcgcacaagaagaagtcttctaagaagcatggcaagtccaataagaagaagtcttccaagaagcacggcaagtccaataagaagaagtcttccaagaaacacggcaagtcgcacaagaagaagtcttctaagaagtatggtaagtccaataagaaaaagtcttccaagaaacatggcaagtcgcacaagaagaaatcttccaagaagcacggcaagtccaataagaagaaatcttccaagaagcatggtaaatccagtaagaagaaatcatctaagaagcacggcaagtctaacaagaaaaaatcttcgaaaaagcatgcatccaaaggtagtgctgtaattgccacgcttagtcgtaagaccggtatcagtaaaggcatcatttcgcttttgacggatctagttgggtataatgatatttataccatgattacgggaaaagatgccgctaccggtaagaagcgctcgcggttagtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgctcgagcaactaaactggcgatgaagcgggcggctgagaagctagctaaacgaaagcccgccaaaaaggctgcgaaaaaggcagctgagaaggctcgtaaaactaaaaaagtcaaacatgcaaaaaatgtccgagcaacaggtcaagcaaagcatgaggcaacccatcgcgctggcacacagttatccaaagcaaaagctaagcttgagcgagagaaggcagccaagcatgtgaaaaatgtccgagcaacaggtcaagcaaagcatgaggcaacccatcgtgccggtacaaaattatctaaagcaaaagctaagttaaaaaatagaattggaaaagttcactttgacaaagacgatgaaagtaagactataaggaaccatatttacaaaaatacagaggggcattttccaaactggtcacaggaacatgatgatactttgcttagggtagcgcagcgtaaatctaattttaaacgtatggatatccatggtaatgactggtatgcagagactatcaaagataataagcaaatttgggttagagtccgtgatggtaaaataactgatggtggtattaacagccgaccagttcctgttatgaaagatggaatgcataaagtttcttggtatatcaagaatggagtgaaattaccttgacaaaaagattgagtgaacaggaaagttacttttcaatgtctgagtttttggactcttattattgggcaagcaaagatgatgatcttggaagtctattggggagtgtcacactttggagtgacgatggtgaattgtttgatcaagcaattgcggaagactggcacgcgttctttagcgacgtgagcaacgaaaatcacactgtgtttgagagttttcaagctgtcaagcagtttgtgaatgagtatttgccggatatcgcagcaacgacaccagtatcaggaagcttgacgtataacattagaataatttgtgagatgacagaatctcaacgaaatcaggaacccgtgtggcaaaattgggtcgcagctgttaattggattacgaatcctaatgttgtgccagtcaatgaatcgccctttcttaaaacggggcaatcattgcctaatccaaaggaaaagggttttcggcaaaatcaatttccaattgccaaggttttgccagcgccacgaccagaaattccgatggggcccagtctggaaaaggtggacttgacacagtcgtattatgcgtttgtgaaatttttacagcattattatcaggttagtgatgatagtgaattgggtaattttttgcagcgaaatagagctatcagtgaaaataatgaagaatatcgctattggaaggggaagtttttgagatgctctggtaataaaaagctattagatattttgaaggccttcttaatggtaagggattactttgaaattgaatttccggacaatgcactgcatacgcatcctgtacgtaaattgagttgtaatctctggaaggcagcgtatctgccacacagccaacgtgttcagactgaggtttggcagaattggttaacggcagttcatcaagtaatggagtaagtatcaatgtcattaaaagacaatcattttggagggtaagttagtgctagttattgtggttattggattatttttgttggcggttaccctaggtttgggatactggagttatttactgggaaaaaggaatcaatctaatcttgttggcaccattattccagtagcttattttgtcgttcgagcaatcttagcttggatgacacaaactacaacacatggcctagtatcgtcattagtcggtagcttgttattcagtttgatttactatggtttatttgtttgggggaagcaccgggctaataagtaacataaattagtcagattgagatgaccgatattcgacaaggattaaatgccgagtatcggttattttatagaaaatcttagaaaagttgagttatgagagaggaaataatacatgctggtatttattgtaattggattgattacggcggtaatcacaattggcttgggttattggagctatattttagggaagcgtaacaagtcgaatttagttggtagtgtcataccagttggttattttatcgtccggttagtttttgtgctagtactgggtgaaggtgttcgagaactgataactagtttagttggtaatttagtgattaccgttatctatgtcctgttgtttgtttggggacgacaacgactcaataggcaaaagcaaacaaaatagttcggttgaagatccagaacgttgatgaagcatgcgttctggactttttagactgttaccggtattaataaaggcatcatttcgtttttgacgaatctagttaggtataatgatatttataccatgattacggggaaagttgccgttaccggtaagaagtgtttatgcttagcaggtgtggcttggacatccctgaactctgtgcctgtctcaggaaagcaaagaagtgaggtagaacatatggatgttgatgagaattggtggtatgagagcgtactaaataaagttcaataaaggtggtagtctagttcagatttaatcctaaagctgctaagaatacccatatccctgtcggtaaatagagaaagagtagagaaatatgaatatagaagaaatcaattcagaaatattaaaggttaacaattatttaaaaaaatgtttatggatggattttgaatttgctagtgtggatggtggagatattgttgtagcaggtagaatagatacttcatatgatgagtttgccattaacattgatttcgggaaaacttattatctgtctagtttgctgtattggaacttaaataattctaagccatttatagagttggcggcaggtaaagaaatgtgggaaattatcgataaataccaagtagaaggaggaaattatatatttaagattaatgctgaagattttgacacagcaccaataattattgctagtaaaggtcttaaagttgaaataataaataaagatccattttaaaaacaggaatcactgagttattaaatcaagtacaatactttcaactcgttcttaatcaggattttagctgattagcccattccagatggttttggataacttgaagaccagtgatggttcaggagcgcatcgattggtccttgggtatgagtttctggttcaactgtggctttggttagtcccgtgtttcacgattagtatggtataccattgtgctaatcacttatgacaagtctgaaaattcttagctattatcgaaatttgcagcttttaaatgttctggaccatatccatgatttgctggataagacagtgatgggtatggcaatggaaaaggtgatgttggacctcgtaaaggtattcgaaaatagtaaaaaatgacaatgattatcattttttgagcagtcatcataggaattacgctgggattaggattatggagttattggttgagaaaaaggacccaaactaatttagtagatgtcattattccagtagcttactttgccgttcgagcaatcttagctgtgatgatacaaactacgacacatggcctagtatcgtcattagttggtagcttgttattcagtttggcttactatggtttatctgcttgggggaagtgcctggctaataagtaatgtggactaaaccgatattcgacgaggactaattaccgagtatcggttattttatagaaaagtttagattggttgagttgtgtgggagaaaacaacacgtgttggtattttatcgtccggttagtctttgcactggtactcgatgacggcattcgagaactgataaccagtttagtcggtaatttagtgattaccgttatctatgtcggggacgactgggacgccttcagaaaaactttctctgaaacctgggacagatacctctgtatatagagtaattaagaaaattccaaatgttgaacgagcaaaagttgtgccttggtttggtatgccaagtgggggaatttaaagcaaactttctatgtctattgaagaacttgttaagggaggatatattgagttaataacaaaataggagtggtgtaatgtttaaactatcaacggaagatttgaaaatttatatattagaaagagtttccaggctgggaaatattaatattaaagaatacaatttcttggaaaacaagcatggaagtgaagatggtttttatatttattcggatggtcagcgataccattttgtgtatagtgagcgaggaacagaaaataagcataatgtgaccgataatctttttgaaataacatattgggttattagttctattacagatacgttagcaataagatatatgagaacgcatattttaccaaatcaaagtcaaagaaaaattatttttgataaaaaattaagtctgttaagtatagtaggtgaaaactataagaaagctggagaaatagaaattagtgaaatattgaaaacatcccctttataggtattctgaactgccagatcaagtacaacactttcagactaagcaagtaatctagttaatcaaagtctggtagcaatcttattgctaattagtaactaagaatttgatgtagctactggctcgaggtgtttaggatagcttgagaactaataatggtcagaaaacaacgaataatctttgagtatgagctccccaattaattgattctagttctcgttggtaccatattcttgtgttgagtaagagcgcacaaagtggatgattgctgaatattggttacttcttaagtaaagtcgcgaaaaataaaataatggtagaagatttagtatgaatcctccagaagaaattaaaggaagctcaaggtatattcaatatcaccctggtggtcaccatggcgattcaccttattataaagtttcttctccagaacatggaattattaggatttatacgaatgggaaggttgtgaaatgatgactgaagacgtagaaaagttgacaatgttatatgacagggttatcgagaatcttcaatagttttcaatgtctccagagaatcagataaaacaattaaaaggtttttcggtcgctgatgaactagcttcggatttttctgatattacattaaattatgcaaagaaattatttgaaaatgcttggataactacaaaacagtattagcagttcctgagcattgatgaaaaattagaggatatgagtaagaataaggcgctttggtgtgaagaagcacttaaagatgctagtgaatggaacaaatgtaggaaagctggaacaaaactgctagcatctttggagggcgaacgctcgacctattcttaaacaatgatcgatttaatcaagacttggtagaatatctatgcctgcttgataaccagatatttgctgtggttggtgattcaaagcatcttgaatagatttattaataaggaataatctttttattgaaattaaaatcaattcagttagtaggaacattgtaaatgtaacagttacttctatacaatgatattcaaaacggtgattttatttttatatggaagcatatccaaagctaaccctattattaacatatatgagttcgaatatgaggctgtcattactagcaatagtagttttgaattttatatgtcaacgccgatgtgaaaatgtcgttttttgccgattaaaaaatgctgttttttaccgataaagtttacagtgtctcactgctcctttctttattttgtgcgttgaaacctgataaatcaggtcatcggtccggaatttaccttcttttcaataaatgatctttcatcgatatgatcgaccagtgattcgataactttagcgtgatgaaccaacgcatctaaaatggcgttagctaacatcttatctgaaaaggcgtttccccacttagaaagcggaatattagtggtgataatggttgatttccgttcgtatcgtctttcaattaactgaaaaaacagcttagcgcccactgactcaattggaagataaccaatctcatcaatgatagaatttgaaaacgggcataccggcgtagcacttcttcgctccggccttgaacttgtgctgtttgaagcttgttgatgaggtcgctacacgaataaactgcgttgaaattccttgtttacacccttcaattccaatggcggtggctaggtgggttttaccgacaccggaggtgccgacaaacaaaacgttttgattctcttgggtgaatcttagtgatcccaagtcctcaattatcccttggttaattcccggttgataactaaagtcaaagtcagctaacgttttttcatatggaaagcgggctagtttaattctcaaattaatctttttttgttcccggtatttaagctcagccgtttcaattcgataaggcatcactcaaggacttgggtgctcatcttgatgatccaataggtagcctaaatgttcggcgaaacgatcaactttaattgtctaaggttgggtgtataaagcttggtaattggccattttctcactccatttcatcaaacatcttcaggtttcggtcgacgtaatcatcaatgactcggtcatcacgattcttataaaggtctgatcggacaatctcttccatgtcacgcgaaggtaagtaatcttttcagtgaaatagggtgagaacgaattaattctccgttataataaatgtatagagtattgtcatcgtgtttaatttgtacggttgtcatcatatagtc

SEQ ID NO: 733 - DNA, 7911 bp, Unknown
  Metagenome-assembled genome
aaacgaataataccgagaaggtctattccgtggtgtttcttttatttgtcaatatcatcggccttgatttcttttgtgtgaaaatctgaataaatgtcgttttttttgcccccgattttttaaaaaatgctgcttgctgttttttaccgataaagtttacagtgtttttctcacgctcattctttattttggcgttgaaacctgataaatcaggcggaatgaattccttctttcattaaatgatcttttaatttcgatatgatcgaacatgctctcggataactttagcgtgattgaaccaataatgcgatataaaatggcgttagctaaacatctatctggaaaggcgttcccacttagaaaggcggaatattcgtggtgatactggttgatttccgttgtattcgttctttcattcactgaaaaaaacagcttagcgcccactgaacatcaattggaagagaccaatctatcaatgatttttagaatttgacacggccataccggcgtgtagcacttcttcgctccggcctgaattgtgctgttttaagctctggtgatgaggtcgcactacagttcgaataaactgcgttgaaaattccttgtgtgtagcaccgcttgtcatattgccatacgtgtggctggggctaggtgagttttacactgactgattttattccgtgatttttttttgcgtgcccgtacaatcacaaaccgtgtgatttatctggtgaatcttatcgtgatccaagtcctcagtataaccctgggttaattcccggttgatactaagtacatcaaagtcagctaacgttttttcatatggaaagcgggctagttaattctcaataatcttttttttgttcccggtgatttagctcagcagcgttgtcaattcgaataacggcatcatcaaggacttggggcttccgtttatgattccaataggtagccctaaatttcggcgaaacgagtctaactttaatgtctaggttggtttaagcttggtaattggccatttttctttctcactcctttcatcaaacacctcaggtttacgggtgaacgaacgtaatcatcaatgactcggttcatcactatctcttataaaggttctgctcggacatctctttccatgtcatcgcatatgcacgaagggtagtagatcttttcagtgaaaaagggttgaaacgaattaatctccgtataataaatgtatagagtattgtcatcgtgttattaatttgtacggtttcgtcaattatcttgatggggggacggagtatttccgatttgaaagagacacatcatattccttgctaacctttttgcgattgttggctgggtataggaatcggtaagcgtgatcaaaaatcagagatactctttttctttatcaagcaataataaggcgcggaatttgagtcgcctgagcttctcatgatttcataatcacacgtcaaatggacgatcatcggtctaattctaagcggctttcaaactcgtggtttaaactttgattcgcggtcagttttggctcacgcctctcgataccttgctttggtgtgtgtggccgcgattatatcgggtttcttgacacatgcaatttggtcttttttgaaccacagacgtccttgcagccgtattcaacgaaggtttttattaattaagatgcacggtttctcatgacgcataaattactttttcactgtataatcgggcacgtgaccaaccttttggtttcaaaacacagatggctttcgcacacccccggtgtgcccaaaaggcattatgttaagcaatcaaaaaaggtaatttggctgcgcgactgaaggaaaattgcatgtatttcatttgcgacgtaccctaacaacatataagaagatgttgcctttgacaattctccatgccgagaaaaacgcaacgtatataaatttctattctttccaatcaaccgggctgaaagcctggcgaggtttcaataccggatagtggcttttttcgttgcggttttctgatggttcaacaatagtctatgagtaatacttttgctttcattgatagaccacgttctttgatttaaataataaattgccgttcccgaacagcctttctagaaccttttcttcaatcgttttcgataatcgtcaacgttttactcgggccgccgtaagggtacttgtgtggctgctcatctgccgtaggttgcgtaaatccctaattgtcagtatctttttaccgttcgtttggatcaaaccgtcaccgtatcgcgcacaatttcccagcgagttggctttattttgttcattatatttgcgggacacaattgctcaacatctaaacgcatttcagttcctccaaatttgagatgcgtttattttaccgtaaaaaaatgttggaaaaccgacattttctaatcggtattttccaacattttacaaccgttgctgataatccgagagtattttcccaaaggaactgaccttgatgaactgaccgatcaagatatcgcgaagtttgtcagggatttaaataatcgaccctgtaaggtcttagtctggaagacaccgtctgaagttttcttcggtaaaaagttacacttgatttgacaattcgtcgcgcaaaaaaggaccaaaacaaaagttttgctttgatccctatttcaacgctgatcactaaaagtttttaaatcagcttttattacagatttatattaacgtttttcaatttcatcttcagcgacccatttatggttggtaacttgcttgccaccatttgtaggctgataatttaccatgtaagctggtcccttttggatctcaactatcgtagcagagctatttttcatccccgccatatgatcagcttttaatgttaccttatcaccttttttgtattcttttcgattaccctcgatttcattaatagtgacccatttatgatctttgaccatttttttatcggaagttgatttgtaatctactgcgtataacttcgagtcataagcatttacgatcgttgcattggcatctttcatacctttcatatgatctgccgttaacttaactttagtaccggccttatattttggttgctcagctttctttaaaccatgcacttttttcgaacctgtatgctcgtgcatttctgttttctcagaagaatgactgtgcgtagatgacccttctttttgagtagaattactagaacagcctgccaccaagaataacatggcaactactgcacacacataccgtactaactttttcaactttcccactcctttttgataaagtctgtttctaccttaactataactaagaaatagctagtggacaacaaattaccctcagcaaattgagtatgctcatttggtagattccaatttaatcggatttctataggcattattgatccctcgcaattcacttggaatgcttaatcaataatcacaaaacattggtctacttgtttcatcatatttgctatctcaatcaaccgttctcacattttccttgcttcgaattaagtcaacaattagtaaaactgctattcccaattgattcttcctaactttgcgcagttacttatcaattaactccgggtgcatattagagaccatttatcgacaaattttggcagataaattaaaacaacgcttttcatggtcagcaaaggccattttgaaaaaacgatggtgaattaagttagagtggcactatttattaactggaatcgcaacgactgtgcttccttaccacatagttttttttagggcgggaggtgtgtcaacgaagatctagtgaaacctcccaatgctcaatacatcatgtttttggggtggatcatcaacaacccgttggaaattaaaaaagaagatattcaagagattttcgaagcctaaatttgcgaaccggttttttaacaaccacccttgcatattcaattaatcaactggccacattttttgcaagtcgggctaccaagtggccaatctgacaattggcatccgttattccatcaaggatgaattaaacccaatcaacttttcgggagcatcaactctattcaaaaaatgacgggtaatgttattaatggcaatgtttgaagccgctatcaggatttcgatcaatcaccatatcgaccgtcattggcatggtttacgccacgaaacataatttcgttaaccttcaaaccagctagtcccacgttataaactttgtgattattctaagctttctagcaaagatatcgatcaccaccaagttaatttagctgaatgagataaacaaataaccagcaaaaattggattatccaagtagaacctgagaaaccgtaagtattttgaaaatgtgtcaccgtatttaccagccaaaatccgatggccaacttggaacaacccgacccaaaggaaactggacgcttcttcgttcaatgacaaccctcgccgacagtcaaaaggttctggacaacgtttggcagaaattcagatatcgccaattgataattgattgaccagcccaaaaactgacggggttacatctaccatatgatggctttgacaagtgggccgccttggcttactggtcaattagattcctcaatcggcgctcgtggctgcacggtgccagcttatcgggccacattctttggaagcttcacctttgatagtcaccgttttttatgctatttcatttactcagcattgctaaacagtgcttgttatatcgcttataacgaatggtgaagcgcgcaaatactgcacgccctcggaagacaagcaggggcaatgttcctggcagtcagggaagtatggggatgaacaaatctcaatttgttcacttgatacccggttagtggtgaaatggatccggaaacagtcgcttgcaacgtcacgttttcactgtgtcagtgcctatcatgtatcatatatatgtcatcaacaggtgatactccgaattcatgaataatacggattagaatgttattgtcaatttgcaagtttctgggtcgtcatggcaaggctaacgataaaaaagatgatcgttcagatatttcatcacgttttcatgggaacacagatgaatccacggcatatcatccaaactctgatgatcacggactcactaataatgcttataccaatatcagggtttcttggttatgttgataaagtcgacagagctgatgagtcataagatcctaagataatcaaatgccaatgaaaaaagccaaacagacaatagttgttctacttgatcaaatgagtgatattgcccacaaacttcgtcacgatatccaacgaagaaggcatcattggtcttccggtatacttcaatctttccaagctcaatttgattcttactggaagaaatcggtgatatatcgcgaatggatcgactgtataaaggtgaaggtaagtcacctgatcctatcaagttctagccaaacaagccgacactgttagcctttattaccgaattaaaccatttagatgaagttcaaaacgtattaccccggcttggttaacaagttgccgcactacttttaccacaattaagattttactttgatcgaacctcagcggagccaccctttcaacgaatgtttttattcagtttctgggatgaacatggatggcaatatggatcaatcctgggcaattgttctcaccgccttgtttctccgattactatgatatccaaggtgggaccactgctgaaggttcaccttggcgtcatgggtgctacgcttgaaattgaaaccaagtgttacggcggggttcggtttgacaccgacgaggtttccaatcaacccgcaccttccaacacttggagtaaggtatcatttaagcaaacgtatcaaggcatcacgtacaattttgaaatcggtcatcataaaatcaatgtgactgccgattcggcagtccatcaaggttggtgacaaggggttatcattatccaagaacaagccaactgttattattacaaataagattaggagtgaaatacaatggcaagttttcagtattaaaggttttgtcttcgatctcgacggtgtaattacggatacttcggttttccacagccaagcttggcatcaagttgactgaccaagggtgggtgccccatgtccaaagaattgaagacggattaaaggaatcagccggatggatctcttgaaatgattttaaaagcaggtaatctacaagaccactatactgacgatcagaaggttgatcttgcaacggaaaaaaatacaaactacttgaaagtggttgacaaaatgactccagctaatattcttccggggattaaagaattcctggatgaaaattaaagatggtgttatctgttatcattagcttctgcatcaaaaaatgctcctactgttttgaagaagctacaattgactgattattttccaaagattgtggatccaaaaactttggcaaggcaaaccagatccagcaatttacctcaaaggtgccgaactgatcaatttgaaaccagaacaatgcattggagcgaagatgctccgctggagtgaatcaattaacgccgctgaaggggtgggggaaacctccttggaattggtgacaagacaattttgaggatgcagatggaactttctgataccagtgaaatggaccttggactaacattaaaaaaacgaggactaattcaatccattgtaaaactgggacattgatgcttaatcccatcatttagggcttcatcccaaaatcccaaaacgaggatttcagggtgaagcccttaatgtgcatgtcgtaagttatttgattaaccgaatgcttccgccattcacaaattccgccattcacatttgacgtagtgacgaagatgcttggctttcaccatctgggtgaccatacccatggcgactgggtatccacttacaaaaattgcaaataatcagctgatctccgaaagcataggacggaatgttccctaattgcgctttcgtcaagagtgcttgaatgctcagttttgcttcgataccccccacttcatcgtatctaaacaggaggattatttctaaccaatgacaattcacccttgaattcatcctgatacagttattcttatcatataaaaaacgttcaagaaattgacttcatgagtcttgtaaaagtccggctcaacgtgcggcgtcaatcttaacagccgatagtaactttagttaagtcattttcagatgttaaggcaaattccattgttatagaatgaaatcacatcgccctgctttttggcaaatgctaaaatctcttcaatcacctcatcactaatttgctcagcctttagctttttccttgatattgaacataactaccgtttcgactgactaatgaattgataccggtagcgtcaatcacatattgatttcaaaaatatttcggccagttgaaattacagggagaatattgttctctcgtaactgattaattgctgcaatgttgtcatcagaaacattctttgattatcaaatagtggtgccatctagatcaaaaaaacaaccgctttatacattgaatttccccatttaactcgatatctacatgtactacttaattactgctccctgaaaatttcgcctgactttgacttttgacaattcgggaataataaaattaaccaaaatcaattttatccagcatagtttattggctaggccaatatcgtaatgtgactgagtgtcgatgcaattaaggcagattccaatttaatcggatttataggcattattgatccctcgcaatttacttggaatgcttaacaatatcacaaaacattggtctattgtttcatcatatttgctatctcaatcaaccgttctcacattttccttgcttcgaattaagtcaacaattagtaaaactgctattccga

SEQ ID NO: 734 - DNA, 179986 bp, Unknown
  Metagenome-assembled genome
ttaagatgtatgaagcgagtgtctctaacggccaaaataatctgtatcgcgagttactagactatgcgaacgacgaaggcaagttggacgttcagtttcgcatgaaaaattcggcattactcagtctgacaggactatccgaacccggcctcgataaagcacgcaactcattagtacaactaggactaattaaatatgctagaggcaagaaaaatgttaaaccacctgaatatcgcattattaatttatatagtaggtcagctggttacccaaccagtaacccaactacaagtcataaaagtaggccaactggtttagatggagtaggtcaaccggttgggcaaggtggaggtcaaccagtagaacataaagaacttactagtactgacccttacttgactgatactgactcttatgatgatgacgcgggcgtgacgcgcgagcaagtcattaacgattggaccaacctgtggggatttccaaatggtattgcccgacctgagattgatgaatggctggaagagttcaagcctgaggtgattgcctatgcaatttgggttgctggagaacatcagattggatccaatgcatgtttgaaatacgttcgtgcaattgttgcgggttggaagaaacgaaatattacgacgttagagcaggctaaaaaggctgctgctaatcatgacgaccgcatgaagagcgaaagaaagcctagtggctattcaaagccacgccgcaaagaagttacgccaaagtggatgcaaaacggcgcttctcaggcggattctaagccaatttcagacgataaccagcaggaagatatgagtgacgaggattttttagcgctcatgaacagtcaggaggaagctaaatgaattggggcaatcaactagtcaaattggccgctaaccatgcctatgaatcgtcggcactgcattggactaagcagcgcatgaagcggcatttaaaggccggtggtagtgcacaagatgaggtgtgcgctcatgagtacaagctatttgcactcgaggttttaattattgaatatcagcgggatggcttaaattttgatttgacccaatgttggggtaagccagccgagtattttattgatttagagcaagctagacaaggattgcaaacggaggtgagcgcatgaatgaattgattaaaatcactgaaaaagatggacggcagttagtgtctgcccgggatctacacaaaggcctggaattaacaacccgatttagtaaatgggttgatcaaaactttagcatgtttgtcgagggcattgatttcacaagtgtaaccggagttacggttgtaaataacggcgccaaacgtgagcttcaagattatgcattaaccgttaacatggcgaaagagttgtccatgatgtcgcaaacgccgcaagggcaaatttaccgccgttattttatcactattgaagataagtggaacagcccaatggaggttgtcaaacgtggatatagttttctgatgagggaaaacgagcagctgaaactggagaatgaacagttgcaagggccagctagattaggccaagcagtttcgggctcagacgattctatcagcgttggcaattttgctaaggtattacgccagcgcggtattaagactggtcaaaaccgcttgttcgattggttaagaactcatggctacctaatagcgatggggaaacgttacaactcaccgacccaacgagcgatggagctgggaatcatggaagtgagagaaaccgtgatcaccaccaatcacgggtcaaagacgcgcttcacgcccctaattacgggcaaggggcagcagtattttgctaataaatttttgaaatcgaagtcaatggtcaaagaggggtgagagcatgactgaaacacaggtgctagtaattaacgctgatctacccgatatcgatcacccactagcaatcgggccagaaccggaaatgtttaagcttgcgcaacataactacaaatctggtgaatggtcgtttccagttagacttgtgaagcctgaaactaagccatgggatgatgcgacctacctagccagtatgaaacaagatccgaagcagggagagcgtgaagatatcaaagccattcggcaagcacataaacatggcaaacatacgcttagagaactagctgatagtacggcaattgaattaaatcgggtaaaggatttagtccataaatacagcctgccactgactaacgattactggcgtgctgagaagtataacgatcctgatgaagtgatcgcctatcaaacactggcgcgattatgtaagaggattgacgccccagaattttcgattagacaggccagtatttctaacgggatcgttaatggctactacattagccgggtgccgaaagtatgagtaaagtcgtgattaagggcgaactgcctagcttaaatgagtacatcaaggctgaacgggccaatcggtatgcggcagctaacctaaagaagaggtacacggccttatgtagtgtatatgcgcgggctagtcataattctggagtcgaatttaattggccttgcaagcttaaatttacgtggtacacaaagaacaaccgaaaagatgcggacaatatcgcctttgctaaaaaatttgtgcttgacggttttatgaaagctgggcttttgggcaacgacaatcgaaagcatatcacggggtttcaggacgaatttgtagttgataagcgaaatccgcgagtagaggtagaggaagttacggaggacgttaaatgattgaagttaaaagtttaacacgtgatccagaatgttgggataagtttccatgcccgtattgtggcggcagagtcatttatacagataactcgataatttatcacggtcaaagatttggcaatggtaagtgctacttctgtacccaatgcggggtgagttgtggagtacatggtaatccagccactaggcgtccgcttggagtattggcgacacccgaaatgaagaagttaaaacaacagtgtcattttaaatttgaccttgtctggcgaaattgtgagttagatagaagtgcttgctatagacgactagctaagttgatgaatattgatgctgaacaatgtcattttggctggttcgacctaagagatttgaaacgcgcgaatgcgattttaaatcataaagaatggtaccaaacggaggacgtgaagtgatgactgatttggcacttaaactaggcagaaagacggtagtggcctacatggtcgtcctgaccttccagggcgaaattatgaaaaactacccaaagctttataagcggtatggcgacgcattcaagcgttgcgagcacttaaaccatgtgatcaagagtgatgactatcgctggaaattgatgtgcgctaagggctggtatgatgttgacccgaatgacaagggggattagatatggatgctgaaataccagcatgggccatacaagcggcctgtgaggctatgggctacgcagatgagtcggaagtagcgtgggaagactacccgctggttatggcgatggcagaatcgatggagggcgaatgatgacgattaaagatttgcttgctgattgggtggcgtggacagcagtttgcttcgtagttgtcggcggcatcaagctgtttgtggttgtcctgggctggctattctagcggtatacacattgataggagatggtaatcatgattaagcttgatgtttggtcggaatgcgactcagctggtattgaatggcacgacacaatcgaagtatcggctgatgcgactgatgatgaaattgagcaagaagccaaagagacggcacttcaacatttcgagtggggctatgacgttattaaaaatggagatggcgacgatgattaagtttagagcgtggtatatgccgttgggaaagtatggtgctatgcaagaaatggtgtacagcagagcaagccatattttagcacttgctgaaatggagccagagaaatacatccctgaacagtttaccggcctgaaagacgtgaacggcaaggatatctacgaaggcgacattatcaagtctagttacaagtatgctcaaccaaaagtttcacaaattatcattgaagatggaaacagctatattctgggagaagacttggctactggtaatgaaatgctggttagtgaccatattggtgaaatcgaggttattggtaacgtgcacactaacccggagctattggaggaagacaaatgaagttctatcgcaaacagctaattgaggccgaacagttcgatggtagtcagacaagtctatttggctatgaagttattccagactcattgcttgatgcattaacaggtgagccagcttattattcaatactgattgacgattttgagcccgaacctgatgactttccagatgataatgaagtctcgtttgaaattggtgattggattgttaatgaagcagacgagatcaaagttatggctgatgaagaattcaaacaacagtatggcgagctaccggtgatccaaaaagtagtagctgattggattgataagtgtaaacataacggaattgcaattgcaagcgcgatggacgaggacaaatttccaaaagaggtagcatactattttagaacttactacacacgtgaccaatggattgaaattcaagatacttttgtccgtgcgtggctagacggatatgtggtggaggaagaacatggctgacaccgaatacgccaaagcaattcaaacgaaagccacagttgccaacctggaaatgaacgcggcaccggcaactaggcaacaggcacaaattggtcaggactttattgctgacattgcggagttgagtgatcgcgagagtaaacaaaaagccgcctactaaggcgactagtcacaggaccactcgaatgaccgttgtaagtataacatataaaaagcgctgccaatgctgaccgtgctacaactaattccgaataaattaattatagcatacgaaagcggaggggcgcatgatgggcgaacagcaagttatttcagatgaaatttttccaccaattgaccaagagaaaacaattaaacaggtgcggcggttcttggataagaagttaccgcaagcagttcgggcgtccggccattcggtcgctgatttaaaatcgcctagcatggatggcatgcctaagtcggccccagctggtaattcggccgaggatcggattacacgccgcctatatgccgaacagattgtccgacagactattcaggccatggctcgctgtgatcatgagtgccaggagatattagatcggctatatttgcaaggttacagcgacacgatgtgctacatggatattggctacagcaagacgcagtattttgaccgttggaagccattggcaatgctacagttcgcgcagagctattacctagaagatctgaatgcttatcaaaaccgaactcaaaccggactttaaccgaactttttccgaactcaagccggacttcatagcaataaactggtggtaaattagtattatcgataattggttagggcgacaaataaacgtttttctgatagccctagccgttttatgtggcggattaaggtaaatacggtatttattatgctgtatgtggttcgattccacatcgctactttagacgggcacagatgtacagtttgtattgcctccttgattaagttgatatgatggcccgtctattaagcagatatgatctaattggcaagatggcggtctccaaaaccgtctatgttggttcaaacccagctatctgtgtagccggcggatttataaggggtgatgcgctcctctctgccgccggcattagtcttcgtatttaacgtcggccgttaaatgtgagtatcgctgtgggctaattggcaagccacaatgggatgtaggttcgaggcctaccggcgatatagttatgcagcatggtcactcatgagggctaaaactgtataacacgtgcttgtggcggaataggtagacgcacagttaggtgtgagtaacgggtgttggttgacaaccagtacgtccacacatcatgtagggtgcaaatccctaccaagcacattaagcaagtaagtatgcaagcgacagtgcgtgaaatcatttgaatcaacaataactcagcttacttgcttgctgttcagtgtggaaaactggacggcacctacataagacgcgcaatcaaacggccaccaaattgcatgcggaaacatgtgcgctgtggtattgtatataggtactgaaagggggctttagttccttcaggtattctcagtaatccttcaaactgctctcgcttattggcgggagttttttgacacataaatttaggagtgacgtcatggcagtaatgattcacagcaagtatgggtacgagccgccagagtgggttcaggctgatgccaggctagataagtggtacaaggacaagaagcgtcgtgcaaataagcatggcgcttttagtttggaaaataaaactaagctggtatatcaagctttacagggcgatggatttaacttggaaaagaaaggaaattgagcaaatggtacatcattacatgacgaaatacgacgaaaataagcattcttacgttgaatcatggattcaaattaatttatttaaacgttgctattgtttgtcaaaacgaattaagcaattgagctagattaattccaaacccgtcgatttcgactggtttaaaaacggaggtaacagaaaatgaacgatgatgttgaatttacaagtaaatgcaaagccttagtactggactacactaatgaacatttagatgtaaccgatggaaaacaaatcactgtcgatgatgtctttattgtttgggaagttaaagcattacagaatagtaaagcgctactcagcacgaccttaagtgatggcatgtattacgagcttacttataacggtgataagggtgagatctacctagacgcctacaaaaagtttgagcatcgatgctacaaaatttagactaattaattccaattaacggaggtgtggtggtatgtaatggctaagtatgaaaaatggttaactcctgatggacttgtccgaattggtggctgggctcgtgacggtctcactgatgagcagatagcgcataacatggggattagtcgttcgacgctgaacgcatggaaaaaaaggttttcggacatttcggacaccataggaaaaggcaaggatgttgtagaccggcaagttgagaatgcactattaaagcgtgctatgggaaccacgacaactgacaagatgtatcgcatggttcataaagacgatgacgtacttgatatggaaagacgacgttttagcaatgcttggaaattaaagcacccagaggcctctaagaaagagattgatgacgctgctattgcgggagtgaaggaatataaacgcattcagcagactgaaaatgttcatgaatttccacctgacgttaatgcagctatattttggttacgtaatcgtaaaccaaaagcataccgtgatcaaagtttccaacagcttaatgaagcacaaactgataaagcgaaagctgaggcacgtattagtagtcataaggctaatgaacttgaaggcgttggtcatgtaaatccattgcttaaagctttagccaaaggagcacagcagttagtacctaaggaggaagaagacgatgcaaacaccactaagtagtattcaatatggtaagaaacaggcaacgtttattttttctccattcgaccatctgtttgatgtgaatgaaggttcaattcgtgctggcaagacggcggcagatgatgcccggttagcgctgttttatttggcaacaacggatgagaaccatttagtcagcgcctataaccaggaacttgcttataacctgtttatcgaaggtgatggcatgggactagcctatatatttgatggtgctagtcatttgagacgtgatcgtggtggcgatcatttagctttagacctaccgagtggaaaaaagaagatttacttcaagggcggggccaagtcaaacagtgccaatgctatccgtggtatgtcattaggctcagttgcgtattctgaaatcaacttgttaaaccatgaattccttgatgaaacctttcggcggacggccgcagctaagtatcgctatcatcttgctgatcttaacccaccggcaccacaagacccaattattaaattttttgatgagcgcgatgcgcactggttacattggcgtatgtctgataacccagtgatgacaaccaagcgtctggctgagatggagacgcagcttaagaaaaatccatatctgtacaagcgtgattggttaggattaagagtcatgccacagggaattatctatgaccagtttgaccaagacagtatgactaaccataccttaattggacaaccggttgaaatgttttttactggtgatgctggtcaagatgatgccacaacaatgagttgcaatattgttacccgcgtccgtcaacctgatgggcgttttaagtttgttctaaaccgtgttgccaattattatcacagtggcacggagacggggcaaacaaaggcaatgagcacatatgccacagaattaagaagatttattttgtggtgtgttaacacataccaactgcactactcgatggtgttagtggatcccgcttcattggcattacgacaagagctaattaaggttggcgttgaagctggtaaggcggataacaacgggcatgatcacgttggtaactctaaaggaattgaagtcggcattcagcggcaacaatcattgattgcagatggtcagtttgtcttagttgatacgccggatagtggactagcaaatcagagctatgataattatcactttgttaaagaacttggtatgtatgtacgtgatgaaacaaccggtaagccggtcgatgctaataaccatgcaatggacgagtgccggtacgctgctaattactttacgaagaaatacaagggaggttactagccttgtttaacagaatacatgattggataaagggggtgttagtcaaaatgggactagctgctgagttgcaaagtgtacctgaccataagaagataatggcggatgatgaccagtatggattgattgctaagtggtttagcatttatcagtcaacaccggaatggttgaaaatacacaaaaagttacccgacgattcttatttagatcgtcagaaaatgtcattaaacatgggacaagttgccgccaagaagatggcaagtttggtattcaatcaaaaggctgttattactgttagcccaaagaacgcgaagaatcctgatgatccttcatcgccagatgattatcaaacgattgagaatcagttcgtacagcaaaccttgagggacaatcatttttataacaattttgaacgttacttagaatatatgttcgcgactggtggcattgtgatccggctatataccgatcgtggtaaagttaagattcgatttgctaccgctgatgcattctatccaatcacgtcagatgctaatggtgtaagtgaagctgtcattgcctccaagttcatgagtgacagtcattactatacgttattggaatggcatgaagaaacaggtacggactatgtcgtgactaatgaagtctacaagagcacgaccaatagcaatgatgacttgggtgtgaaaattgatgattggagtaacttgccggatgcattcaaaaacatgtcaccgcagccgactagatattccaaaaagctttattcacggccaacgtttatctatttaaagccaaatttagctaataacttgcacattgacagtccattgggtattcctatctacgctaacgctatagacacattgcgccagttagatgaagcctatgacttgttattccaagaatttgtcaagggaaaacggcgtattgccgcaccagcaaatcaattgaaacgtgaagttgacccacaaaccggtaaaacacggtattatgttgattggagtgaagatgtctacatggcatacaacacgacaatgagtggcggtgatggtgagtcagtgaaaccgactgatattacattaggactgcgaaatgaagcaattgtggctggcatcaatgatttgttgcatttctactcttcacaaattggtttcagcgcagatatgtttacgtttgacagcaaacagggtgttatcacagcgacagcggtaatcagtgagaatagtgatacgtatcaatccaaaaacagtcatgaaacgttgattggagaagcaattgaacatatttgccagattattgtggagctggctaaaaatgattcaggcgtacaatattcaggtcaaacagatattgatatttctgttaactttgatgattcgattgccaaagaccgaaatgataatctggattattacatgaaagctaatggcaatcaccccgtcatgacacaactagaagcaatcaagcgcgccaatggaattactgatgttgaggctcaacaggttcttgaccaaatcaatgcagaaacagcaaatgctgaaggtgcaattgaagatgttgtcggtggtaacggtaaagatggtgagggtaatgcttaaaccatgggatttatcgggttattcggatgaagatgctaacaactatgctaatgttgaagatttgatttggtctttcattatcaacctgataggaaatgaagcatctaaacatgatgataccgataatgaatggataaacgaattacttaatcatgcagatgatgttaggcaatatgctgctaaaataactgtctcgcctacacagcatgcgtctaaacaattgcacacaagacttagtacaattagtcaagataatgtcaaacaagctgaaaagtggcttaaaaaggttactggaaagcaagtggattcgatcaaggattcgcaacagtttaagcaagttgttgatgaccagttaacagagacggataattatctgaaccttgctagacgtaatatgagcgcaaatgcgtatcagatgtttaggggaattgttggtgatgcaaagcggtcaatcagcagtggtacaactgccatcaaagcaatggctaaagctagtgagcaatgggcagaacaaggtgtacccgcactcgttgataaggctggtcgaaaatggtcaccagatgtctatgtgcggacagtggttaactcaagtattaatagtgctacgaatgatacagagttacttaggtatcgccagtatggttcgttaattaaagttagttcacatattggttgtcggccaagccacttgcagtatcaagaccatgtctactcattggacggtaatacagacaagtatccagatttcgaatcaacaacgggatacggtacgattaccggcattgggggaattaattgtcgacattatacgattccatatattgaaggccacggttcaatgccagtgtcacagcagccagatgatgagaacgcaacccgatatcaattagaacaaactcaacgtcgccttgaacgtggggtgcgaaaagctaagcgtaaactgatagcagctaaaaagtttggcgatcaaagtgatattacggctgcacaagaattagtgagccgtcgtcagtcagttactcgtcagtttgttaacaagcatgggctagtacgtcaatacaatcgagaaaaacagtagtgcccttagcatggcgttaaaaggcttattttttataccttaatttagagaggagtaataaatatggcagaagataatccagttccaacacctgaaccagtgccggttactgatccagtaccgactcctacgccaattgatactaaacaggtagccacagaagcgcgtgccgaattattaaagtcacttgggttcgataacgaggatgacttgaaaggtgtcgtcgaacaacataataaagatgtggcggctaatcagagtgcattggaggctaaatctggtgagttagacaaggctaccagtaaacttgcaaaagaaactagtcgtgctgacactgcagaagctcaagtagctgctcttaaacaaggagttgatgctgatcatttgagtgacgcgttggcgctcgctaaggccgacttagcaagtaaagctaatggtgtgaaaacaatcgatgaagctttaactggtgtcttagagcgtaacccagcatttaagggtgcagaaacagtgcaaggaacagccgttgctggtcaaaaccttagtggtggccaaggtaacgttgcagtgccagatttgtcaaagattagctacggtgaagctgcaaagctgaaacttgagcacccggatgtatacaagcaagctgttacaaaactaacaaataattaggaggaaataacacatggcagatgaaacaactgtattagataacctgattgatccacaagttatgactgcgatgattagtgctaaattacctaaggcaattcggtttagtgctattgcacctgttgacaccacacttgaaggtcgaccaggtactgatgtaactgtacctcgatacaagtatatcggagatgcgacggatgtcgatgaaggtggcgctattgattatgccagtctttcaacagataccgacatgttcacgattaagaaagcaggtaaaggtgtcaagattactgacgaagccgctctatccggatacggggatccagtaggcgaaggtcagcgacaaattacgatggcaatcgcatctaagattgacaatgatatcttggctactgcaatgaaatcacggcttacgttaagcactggcgttgatgttacgtcattggatatggtcgatgcaattgaagctgcatttaatgatgatacgagtgagtacgcggtagaagatgattcaccgaccacgggcgtattgtttatgaaccctaaagatatcaataaactacgtaaggctgccgctgagaactggacgcgagcaactgatttaggtgacaacatcttgattaatggcacatttggtgagttacttggatggcaaattgtacggtcacgtaaaatcaaagaaggctccgccttggcagttaagccgggtgcaatgcgtacttacatgaagcgaaatgttctctctgaaaagggtcgcgatatggatcataagatcactaagtttaatgccgatgaacattatggtgttgcaatctatgatgacactaagttgttagtcattaatccatttgatgtcgaaggtggtactgttattaaccaaaacgtaaccagtactaaggatgctacggttaaaaagtccaataagggtaaagctgtggcatctgatacgccgtcaaaataatgtcgccgtctaatgtcaaagcaatgcctactaatgacggtgcgaagatcacagcaaagtaggcaattaaatttaggaggaatgtagaatggctaaagtgttgaatgtttataaaaaaggcaacgaagcggcaattgcaactggtgatgcaaccagtgtggcaattactggcttagcagctggcacagttgtcgctactggtgactatcaggttgcctatgtggacggtagccaagcgagtgacaaggtagatgttccgggatttacggttcttgccgccaatcctgctaatccacaagatgttaaagctgtagcaaccactgatggtgccagtgtaactgctagttagaggtgattagatgccgatagtagatcaagatttttacacttatgtttattttggtgagacggtaccagcaaatgttgagtttgaacgtttggaaatacgggccgaagagatagtcaatcaatacgcaaattattatttcgattcgcataatcttgatgatttgccacttgacgctgaccgaattaatgtgaagaaggctgtctgcgctcagattgaatggtttattgattctggtggggttgaagaactagctaacgctaaacaatcggctaaagggattagtcatgtaacgataggcaaatttagttatgagaagtcatcacccgcgacactgccacgtagtacggcacagcgctccaatgcggcaatcaactacttacgaccaactggcctattgtatcgtggggtgcactaaatggatgatattattgatccaattcccattgagttgttagatgatgctatcaaagtgacaccctgcgacgctaataaagctaaacaggattcatggactaccagctcagatagcgatggatctgatgactacacgattagacatgtacgagttgaacctgcaacttcggtgtcagtgcaatctgttggtggcgatgctagtgtacaggtcgttactggggcttatacactaattgtggattcaactaactcgacgccactagataggttgcccaagcttaacgacaaagttgaaatacaaagtacccaccaatcgttaatcgtgaagagtcttgatcctatttatgattttggcacgcatgttcatcattgggaaggggtgctgcaatgactaacaaagtagacttgtcaccattagttacacgtttgaataatcttaatgtgctgacaaaccgactagcagatgtgattgtgcgtgattctgaccaatatgtgccatttctaaatggttatttagctggccatgtatcgagaattcaaaccggtactggcgttactattgtttggacagagccgtatgcggcctatatgtatggtggtaaagtcatggtgaaagcaccggatacaatgggtcagcggagaggctatcacaaagtagtgacgagtcggcctttgaattataaccacactaagcatgcgttagcgcaaaaaggttgggttgataaagcctatttggttaatggtcacaattgggcagcactcgtggcacacggattgggggcgacgtagtgagtcaagttgaccttgatttggatgttcgggttgctgattacatcagtgctaacgttaagctgtttgatactttaacgctgggtaacgattatgctcctggaatgtcactgagttatacattgcaacccgctggaccggcaacgcgatattatgacggtcgccgccgccgtagttttgcatttgcaatcactgctaaacatccacacggaattgtttgtattaacactctcagtgccattatggacatcatggagaatgcaacgccgatatcaatcaaaagtgagaatggaagtttcaaattcataagcgctaagatgacaacctcaccggagtttctagccactgttcaggatgacgatggtcaagatgctcaaaagtatggtgtctatcaaggcgcttttagtgtacaagtaattatttaatttaggaggaatgcaaaatggctgatgcaacaacaccaacagctgacccgaacgacagaaacgtccaggggtcaattcaagaaaactatttagatgaatattgggtaggaaaaactgcggcagataagacgatcaactggttatatttaggtgatggtattacgactgtaacgcctaaatatactgataagaagaagtctgctgcctactacaatggtggtggccaagaacgacaaacagttactggggtaacgtcatcgtatgatatttctggtgatcgttcaattgggaacccggcccaagatgatattgccgacatgaagcaaaagactggtggcttacgtgaacggatgttccgtaaagtccaatgggtacaagaagaagatggttcattaacacctaatgcgattgaatcaggtatgggaacattctctgacattgatgatggtggtggcgctgcggacgataacggtagcttcaaggtaacgatgacgtacaacgctactcccgcagtaatcaaggcaagtgacccggctgctatgacaacagcgttgaaagatacaccttgtcagaacgctattattttgggcgttaaagctaattcgttagctggcagtggtgatacgccgtcaaaataacagcgccatcgggtgttcaatctttacctacaaacgatggcgcaattataaagagtatgtaggcaagtgacggagcgatccgtcatacatagcattaaaaatattaggaggtaccagcatgagtgatgtaattaaattagaggttcctagtgacagtatgacttttgaaattggtgataagagttacacggtgagctttgcagataaatcatttgctgtttttacagatcaatataatgatattaaaatggctgaggtgaaattacagcaggagttacatcatcgatcagttgagttaactgataaagaagctcaattggaaaaagatatgattaatgaaccaatgacggcgttagatcataagaaacaaatcctacaacgacgctatttacgaatgtacgatgatattcagaacaaatataagcttgaagctaaggaacgcttttatcaattacttgatggcatgtttggcaaaaattctggcaaggaactataccatacttgcaatgattccatggtggtatttgctaaggttgtcgctcaaatcatgattaacgtagaacaacatacggatatttctgattatcgtgacaaatacctaaaatccattacagaattgcggaagaatgaacaatgagctttaccgagataaacactagcagcatcgtatttcggaaacatcggtatcgtttagacctttcatttcgcatggtgttgctctattttaaagcgattcgggatgaaggcctcactatatcagagcgtgtagaagtcagcttaaaagcgctggtattggacgatacgagcaagctacgttttgaggacaagggtcagttactgtctgaaatatttaatacaaaaattaataatgaccgcgatcgaattcgaaccaaggtgctcaagtctggtaagcggtcttttgattttgatgaagacgaatcgttaatcaaggctgggttccaacaacaatatggtatcgatttagaccgagatagtctcagttgggaacggtttaccactatgttggatggtcttaatgaagatacgcaatttaaaaaagttgtcagatttcgactgaccaaggttagtgatgatatggatgctgatacgcaaacttatttaaagcaaatgaagctgatttatggattaaagcaagcccacaccgatggtgatggcaagctgacaccagatgaactatctatcgagctggctaatttagatatgccgcataaagcgttacggatgaaagagctacgggagcaagggaaaatatagaaaggatgtgtgtagatggctgatattgctggtagtgtcaagattaacgtggacttaatcgctaaagaggcgcttgcacaagccgaagttcttaagcgaacatttaaagacgtggatgttagcccgaaagcagctgccaacttaaaagtgttgaatcaagggttagagacaactgcagccagctatagtaagctatcagctgctcaagaacaagcagggctgcacatgtcttctcaagtttctaagttgaactcttataaagcacagttgcaagctaaccgacaagagatgacagcaacagctggtgaaattgggcgtctgtcacgagcagaaggtgataattctgctcaagtagtagcggctaaaagcaaatatgctgcccttgaacgtgaacagcaagctctggttttgtcagcaggcaagttgcaaaaaggtgttggtgcattaacacctgaaatggctgccacagctgacaaagccatgataatgggtactaagatacaaaatgctggtgaaaagattagctctctcggaagtaaggccactattggttttacagtacctattgttacagcgctaggtgtagcaactaaagccgcttccgattatcagtatcaattagctgatatccgtaaggaagttgttgcgcaaggatactctgcgaaccaaacaagttcaattatgaagaatctatcttcagacacattaaaatggtccaaagagtttggtgttggtaccaaagaaatcaatgatggtatgtttgaattggtttctaatggttacaatgtcaaacaagccatgggaatgatgccagagttgttaaagactatgacagctaattctgatcagtctggggagtctattaaactgactgcttctatgcttgagcagtttggtcagaacttgggttcaaacagtactgtaatcaagaatggtaacagcctgatgaatcagatgaccgaagccacccataagtcagccatgtcattagatgatttgaaagaaattagtggtaatgccggtgctgcaatgcacgccatgggcgttaaaacatatgaatttatggcaattgcagggcgcttaaaatctgctggtattgacgctagctctgttggtacagggctgtcatcattgatgacgcgagttggaacagggacaggtcaagcagctaaggatttaaagaaatacaatattcaagtattcgatagcaaaggcaaaatgaaagacgtctttgatattcttggacaaatgcagggtgcctaccagaagatgaatgataagcagcgccagtcatttatgtataacgttgttggtcaagaaaatatgaaggttggtatgaccttgatggacgctaatcttgaccggtacaaatcgttatctaatgagatcgaacacagcaatggaaccgttgataaatacaacaaaacaatgcgtaacacgagtcagttcactatggcccaatttaaatctagtttaaacgctttagagattgaatttgggcagaagttcctaccaactctcacgcccattattcgtgagttaaagaatatgctagaccgttttagcgacttagatccggcaacgcagaaactaattcttaatacaggcttagctgttgcagctggtggtccattgattagcatgtttggaaaattgacctctagtgtagggctactaactagtggatctatgaaactattggttggtgctgctaaactatcaccgttatttggcactttagttaaagatggcggtgcggccagtactgtcattgctggccttagtggtggcgcagaaacaggttcagcatccttgttaggtttaggtgggtcagcattaggtacagtttcaggattgggcgcattggctgcggctgccgccccggtcgtgttaggtgtagcagctgtggggacagcaacttattttgcgattaaagccggcaaggagcatagtgaccagttgaagcgccaacgtgcttcgatggacgaatatggtgccaatattagtaaaaactcgcaaaaagcaattggctcgtttaatgaactacatcaaaaagccaagaatgatatggcactattggacactgcggtaggtaaacagtctaaacaattatctagcgatgtggttactaaatacagtaagatggctgatttggttgaacaacagttttccaagactaaaaaggctgggatggacgcactatccgacttatctagaagctttggaagtgctggtaatagctgggtaacgcaagtcgaaaagggtgttgataagcgggctgatgggcaaactataaagcttgaaaaagctaaaaaaacgatggagagcattttaaagtcagttgacggtgacttctctaagttgtctactactcagaaggccaagctaaacgaggctgaagcttacattgactcgcaagtctctgcctttggtatggcttataaagaccagcaagcgttatataaagcttatgtgcaacaacatggcactatcacggatggcatgtataaggcggacgtaaagtcagcagattcggcatattccaagacttatggcaaggcaagtgatagttataagaagagtctgtctgagctgaaatcgctaagaaaaaatgaccaaattagcaaagaccaatacgaccaagcgcttgccatgcttgacgctaagcgtaacaagcaacaaactcaagcttcgttggaatacatcaaaactgaaaaggcggctggcgatgcgtataacaacaatggtcgtgaaagcttgcgtactaagcaaacgcttgatgatgaatacacgaaaacgattaccgatgagaatggcaaaaaggaaaaactttattgggacgatgtcagcaacagcgaagaatctgcagctaagtggattgcggaccataagaaagacaatcagaagtacattgatgatcaagtcaacgcgcatggcacaattcagaagaatatggctaagttccagaagtctcaggaaaaagcctatgaggcaatggggatgtccgactctactgctgctgcacaagcaaaggtggatgccgataatatgctggcggagacaacaaaagcaggtgctaaattggccgcaagtgctgaaaaaacgcatgataattatgttaaatctttgaataaaggcactttgggaagcccagccaatgttgctaagcaatggggacttgatctttctgatagcgctgcaaacatttctcttggtaaatacggatataaaactgcacaacagttctggactgatgtcaaatctggtagcaaacagggttatgaagaagcacaagtatatttcaattcaattctaactggcttcaaggatgacggcaaaaagaatatcagtgatttaaccgattctgaacaggaagaacttcgatcaggtctttcaacgggaatcttatctttgaaagatttagctcctgtttttggtaatacgattactggccttttcccgaaagacttgtccaagctgagcggaaaagaaattgatacccttaaacaagggttaaccgatggagccgtgactatttcagatttgaaacaacaatttggagacaatattaccggtttgtttcctaaggatctatcaaagctcggaaaaactgatatagcaactttaaaagaaggactcaaaagtggtgatatcactgacgctcaattgaaaagccgctatgacaaacaatatgctgctatttttaagcaagatttatctaaattgggcaagagcaatatccaaacgctcaagttaggtttggatttaggtatcattaccaagagtgatttaaagacacactatggtaaagcaatttctaatatttttgatcataacttgaaaaagattgggcaaaaagatattgatactttagcaactggtattgatttgggaattcctggtgctaaatctgcattgaataagctaaagtcggcagtaaagagtggagctaaaatcaatatcactggtgaagggtcatggaccatggatacccttaacaaggcttatgctgataaaaaaatttcaactgaaaactacttgaaagtattagcagcgatggttaaggggaagactaatattgatattggtgaaagcggccgtaagaccatggatagttataacgatggtatcaacggtgagaaaaaggtgcccattaattcagttacggggactgctcaaaccatcaaagatgttatgactttggggcaaaaagctgttggtgctggccacgatacaatggaatcattcaatcaaggcctagtcgataaagctgccgaccccctgaagtctgctggcggagttggaaagggtgttgctcataaccttgatcaaggtggagctagtgttaatgcattgtctaaagctgttggtggcaagagttcttacacagcaactgaaaacaagttaagcataacgacagggataccacataaaaccggtaccaatggcaaaatcaccagccctgaaaccgcgatagttggtgatggttataagccagaattgattgattacggtaatggatcattaggactgtcaccggctgttccaactgtgacccacttgcctgtcggtgctcaagtcttttcaggtgaggatactgaaaaagcggcaccattccttaaaatgatggggttaccgatgtttgcgactggttctggtggcaacatcgttgattggatcaagaatctatttggtgatgctatgaaattcatggagcacccgattaagaactgggaaaaattaatagattctagtttcaacatgaacctgtttccaggtggatcacaaagtcatttcgggccagatacaaaatcatgggaaaagaaacaaaccaattggctaaagaaactagccattgagggtgctggtaatcctggtggtgctggcgtaacgcggtggattccgtatatcaaacgagccgccgctgctatgcacgtatcgatgcctgaagatggcgttaagaaaatccttaataccatcaatcacgagtccggtggtaatccaacagtatttcaacatggctatgtggatgtcaatactggtgttgaccctgctcaagggttgcttcaatttattggacaaacattccggtattacgcggttaaaggccacgggaaccgtgcgaatggttatgaccaactattggcgttatttaacgattcaaactggtacaacgatttgatgtggaatcgtggttgggcgcccagcggtcatcgtcgttttgacaagggcggtgagtcctatgagaaacagttggcctgggtatctgagcataatcaacgtgaaattcatattccggatgatcagtccaattacagcaagtatttaacggaacaagctgtcaagatgtcatttggtcagcaggcttttgtcgcaacgagtgcagagcaagctgctggattaaagagtaccattcctgtagacgttcctaagaatggtgggcctgtcgcggtcagtggtgcagcggctaacggaactggtgaggtactaggcgtggtcaagtcattagtggacgcaattactagcaagacagttaacatcactgccaaactagataacggcgtcctttttaatgcccaatatccgttaatcaagctggctctaggacaagatgttgtcattgaccgagcgagaggaggtaaatagatggagttagatattcaagtgattcaacaggatggcagtaactactggctatctgatttgggtattcaagtagaaaagttttcaccacctgcaccaacattcactcgaacctacacgccagttggtaagtacaatgtagcttcatctgaaacacacacgagcgaacgcaagataccgctagtttttgacgttaaaacaattgactcagttgaccaagaactaatgcggttgaagctgtttgacttattccgcggctacgaggacttttatgtcgttagcagtgttattccgtcaattcgttggccggttcacgcagatgatgggtttaatatagaaccttatgaggcatcacccattatgacggaggatatcacagttaacctagttgttactggtggatttggcgagacaattaacaccactgccaacatgaagaataacattccattaggatttgatattccatttgcatgtttgccaccgtatcgtttcaccaatcaaagtgacgtcaaggtgtttgttggtggctcaattccgttgctggctgatggcaagacggccacattaaccttccatggagatgtggctagtcaattatcgattactaacaaaactacgggacaagtgtttcagttaaatcaagcgttgaagaaatcccagactctaattttatatggcatggttccagttgtggatggtgtgaatgtctacagcaaggggaatcatgcctatttagattatgtcaaagggattaatgaattactagtggcgggcgcaacgaattatgatttggagtttgatacacgctattacgtttaggaggtgtgaaagtgttttatttacgtgatgtaacaggtaacgaactaccagttatcccaatttcagcacaattgactgaaactgtgaatcaggtggcgcagttggaattaacatttattaacacgggtacgaatgcgtctgctgtgggtatgttgcaaccacgcactctcttgctggattccgatagtggcgaagcttatcgtattcagaccatgaatggatctaacatcggtgggagtcgtaacgtcaaggcaacgtttctaggttctgtgcacgatttaaacgaccattacgttgagaagagtataaagggatcccagtcgctcgatagctgcatgcagctaattactgaaggcactggttttacgtatacgattcatgatgatttcaatcattatgatttttctgaagattttggtactggcttagcatttgatttattcttaaacactttgatgtcagacttcaatttcgaatggactagtacgggcaagcacattgatatttataaacaagtcggtaagcgtgatgctttcgtttggttagatggattaaatcttagctcgttgacagatgagagtgattacacaacgattgcaactcatattaaaggtacaggtaagttagacgacaaggaaaagccattggctactgctgagtacacgagtcctaacgcaacaacgtggggtgtaattgatgcagagccaatttctgatgagcggtttacaaacagtgattcattactggcatatttgaaatcgaaattacaagatgtgccgttgattcagcgaactgcgacattgaatgatttcaagactaactcggtacctggaatgattaataacagtgaggttggaaattacggctatattcgggatcgtaatggtgtggatgttgaaactcgaatcagtgaaaccgtgattgatttggttaatccagcgacgacaagcgtgacatttggcaatatgaccaaaagctttacacaaatcaccgcaggattgcagactgctcatagtgattctggtaagcagatcgcacaactaaaggccggacttgatgctgtatacggcaatgatttgattactgatgcgaatacacttgacagacttaatgcgttgggtggtgccgtgaatggataaaatgacggtgcaacaggctattgatattctttcaatgcaatttccaattagctgggagaagattgccaataaaccagagttagtgactagtgatgacttggaccagcgactaagtttaattgggcagttgacctcaccagatggtactgcatgggtacctagcattgataatgatgggaaagtcatttggcgaaaagtagaaaagggggaaaaagatgacagcacaactagcaacaaatgaattgtcggctgtaaatgatgaatcgtttcgtaaagtattaatttcaaattttgaaatacttcaacaatatctaaataaatttgatgaacttgccgatgaagtaaactccgatcaatcacgtcgaagtgctgacttaaataaaaagcttaccgacatgcaacaacaaataaatgatagaattaatcggatcacaatgggtactgacgaagatacaattcgtttagttgttacggctattctacaagagcagggagtgattaagtagtgcaaagtttaacttatgtaattggtaatgataaacgtaatttggtcgatgacattcagaatttcaagattgattttgaggattccaatttaaactgggttcaggcccgacaatatgaagacgggatgcgacaagtttttgtcactattaagaatgaagacagcacgccatttgacttaaccggctgcaattattggtttgaaggcatcttaccagatggcgtccacaaaattttagatgccaaacatggtgtggcaattgatccggttaacggccaattccgctttgacatgccgaaacaagcgtttgccgtagcgggtagctatgtacaggcattcttccgaattgtccgagacggtaattcggtcaccactctggagtttgatttggaagtgttggccgacaaggtgatttcggggttggtgccaagcgactacattacgccgtttgaagatttatatgctcagcttcaaaagatgggaactgatacccagacgatgttgcagccgcttccgaaacagatcagtgatctagaatctaagatcacacaggatggcttgtttacgcaggcggaagcggatgcgtttaagcagactatgcaagatgatgtcgcaaagatggacgcccagattgaaacgctaaatcagaatggttatcgtgtccttccttataaaatggtttctgtaactaccgatcctgtaggcgtaaacggaactatttcagaaaatcagatcgagcatctggctaccatcggagctagtttagctttggttgatatggttaatattcaaagcgcgactgacgctaatccaacaaaatctgatggccatgagatgcaacgcgttatagatttatgcacaaaatataacgtccccatccaaatgctaaagccacatcttagtataaattggtccgataatttttatcgggcgaattataatcctaccgatgtaatatcagcgatgaaaaactggggtagcatactgatgtcctatgcagacatctgcaattcgaataatatttcaatcctatgtattgaatgtgagcaatacattttgacacaaaacaaatacttggattcctggacagacatcattaatcaaattcgtcaaaaatatccgaatctaaagttaactgccgcatatatgggttttgaaattgttgatccggagcacaaggacctactacaaaaattagacattatcggtcttaacgtctatccaggttacattattgacagttacgatgagtcatttcctgtttcctatctagttcaagcgttctataacacggtcgccggctataatattgccgcccttattgaccaagtatgtgatgagttacagaaaccggctttaatcaccgaaactggttgtattccaacgatggaagggctgacggcactggtgccttcagactacgattcaagcaaaggcgctaatgactatgaagtaaccgcgtatctcatgaaggcaatgttccgcttcatgcaagaaaatcgcaatattatcggattcgcttggtggcatttgaacaaaccgttttcgttttttgacgattcaaataatactgataatttatcaattgctgagcaagtcttcaaaagctatattgaaaggaagctgatataatgcctgttacttacaacagtgacgttcttggccctacaacaaatttgattccacaatacgatcagtacaaggtttattcaacaccgccattcgatgaaaataattgtacgtttcttggctcactgaagttacaaaatgatcccacgcagatcacgaaacaagttgagcgtaaagctcgacggttcacacttgcacttcgttgtacaaacggtgaagatactatggttcataacgttagtgatgtctatatttcagcttattttgataaaccggatcatttagctgtcaacatcggaacaaagtcgctaacaggattttatgatacttctgaattctataaattctacgtattttggacaaaaacggctcgtagtgaaacagtcgaatttgaagttgaactctggatggagacaagagacggcattagcgctgttgatcttcaaccaactttcttcaaaacatatttagacagtaatacgcaggctaactacgacaaggtggctaacattcattacaatggctattcacgtattgacgctctatttgcaggcatggcacagaaaaatattagtcatcaagacatgatgaatcagcattcttcgggttatggatccgctcaaagctattctaattatacggcggataattctacaaatgatctagtcactcttgattcttatcaatcctatgtagtactggcaacaaatggtgaggctcgaacaattgcgacgattgctccggcgactgattatcaatatcagaatggtcggcgattagtttgcttttgctggaatcccattacgttccatcacgctggtaatcttgatagcgctggagacaatcatctagtgatgaaaggaagcgctgattataagactcaagtcaatgaagcaattgaattcctacgagtaggtaatctttgggttcaagtttaggagggtaggtaaaatgaaagtaatttatcgagtcagtgaaattggtattcgggaggtatcagtgccagatgattatgctttgcaagctggagaattaccgccccaaccaatcgttgttcacaatccttcatcagtagaacagttattgatgcaacaagcacaacagattactgttcttcaatatatgatgatgcaacaaaaccaaacgcaggcaatcgaaaaagctaaggaggtagcagcgcaatgatgacacaattacaaatgcttcaaatgttttggaatgattggggcaaccacgaccttaatttctataaggtctacgtccagtatggggcaatcaccaaggacgattacaagacgatcactggagaagcatatgtagcaccaacaactcaatcaccagtaactatcagtcactcagccagttagtcagtgcttttaattttcccaaaattggaggtcagcaccggaagatacagtaaaataggaggtagacaattgaataagcacaagttaaaggcactcatcttaatggtgggcgccatttttatgacccttttaatggtcaatttaaacagtcaggcttcaactagccgtgaccaaggggtcgactggtctaagtataacggcaataatggggtattcggatatagcaccgataagtttgtattctcacaggcgggtggcttctatggtgggactaatattcctcagaccacgtataacagccaagttaagtcagctcaacaggctggtaaacgggtacacacctatctatgggatggtgttggtggcaatatgaccaatgccaaggatatgatggcttattacttgccacgagttaagacgcccaatggtagtattgtagcgctagattatgaggacggtgcttctaatagcgtgacagctaacactaatgtcattctagcccagatgaagtttattaaagacgctggctataccccgatgctgtactccggcaaggcctatttaaacgcccatgttaatgtgagcttgattttgaaggcatacggtaattgcttatgggtacctgaatatccggattatctggttagaactaagccggattacaactggttcccatcaatggacggcgtggctatcttccagtttacgagtatgtataaattaggcggattagatggcaatgtcgatttaacagggatcactaaatcaggctacacaactgctagtaagaaacaagctcaagccaatgttaagaaggctcaggcagctaaggttgttaaatacaaccagctaggggtgttctaccctgatcggactctagccgtacgatacacggatagtgacaaagttagccaagtagctacctattacaaaggcgagagtgtaacttacaacgcggttattatcgagcatgactatgtatgggcacgctacacccgttcaaatggcctgtacggtttcattaagctaggcatcaccaacgggccagcctacggaaagcgagttactggtcagccggttagccatacgtattacacagtcaagttcggcgacagctggtggacaatcgcacaacgcaacggcctaaatatgactacactagctagtcagaacggaaagacgatttacactactatctatcctgaccagcgattggtggtgcggtaattgcatacactattaggattaggctgggatgaatggggatcgattgttgccattgtcactagtatttgtgtattagctaattggattctcaataagacggtccgtatcccgcttaacgatttaggcaagcggcttagccgttttaccgatgaaagtttaaaagtgagacagcaaaatgccgacacaatgaacgctattgaaaatcgggtcattaaggtagaaggtcgattagatggtcatgacattgaatttaaacatctatatgaaaaggaagccaaaggaaatgaaaaaaattagctttaagaatgctgatggaagcttgaatggtaaattgatcgctgggatcatttcgttattaattgtgttaattcaacaagtctttgccatgtttggcattaagtttactggtgattggtcagccattgttgccgttgttaacactgtattaacaatccttggtatgttgggtgtgattactgacgttcaaacagtgacagcaccaacagttaaaagtgacgaggaaatccaagtcgaagcagcagctaataaggttgctgacgaagtgcaaacgccaacgtccacagtagcatctgacactgaaacaacgtcacaagcaagtcaaaagtagcataattaatcccctgcgtttcggcgtgagggatttttttacgtaaaaagccgcctgccgtgagggcagacggctaatacataagaaaaagtatcttagcgaaagagaaaaccagattatcactaggttccataattatcataggaatatatgagaaatcgtgcaactttaatactcactactgtgaaactacattactggcaattggcaggtggtattctaaagctggttattctcacacgtattatacagtcaagtacggtgattcatggtgggcgattgcccaacgcaacggcctgaacgtatatacgttggctactcaaaatggtaaaacgatctattctatgattcaccctggtaataagttgattatcaaatagacgaaatccccacactggcaatcgctggtgtgaggatttttttaagtaatcaaattgtgtcgagtttattgcattatcaactataataagatatccttattatagtttgtgacactatatgcggtgcgaaggtgaaaatcattagttcaattgaaaagttagagcgtagattttatgcagataaaatccccaaaaacattaagtttgaagatgctgaaagattattgaaatatcatggttgtaaacttacgaacaaaagtggtggatcgcactatgcagttacacatccgagtattgatcgcacaataattattgcaaggcacaatacagcgttaaaaagatacaatatcaatgatattaaagcttttattgatgatattaccacaaattaatgtggaggaacgataatgaaaaacctagaatattatatgaatctaaaatatcagatacaaattaatccgatagaagaagatgatggtgaagaatattttcagcttgtgattccagatcttccaggatttaaaatatatgaagattctatccaggaattaatggaaaacgttgaagatgcaaaagcggcgtggtttatttcccgtataaccgaaaagaaagaaataccgatgcctaatacaattaaaaataattattcaggacgtattactttgagaatagctaagtcattgcatcgtgaattaagtataggtgctatgcaagatggaattagtttaaatagttacattagtaatctgctactgttaaataacaatcagaatgctatgcaagataaatttgatgcgataagaaaaagtattgaaagattagagtcattaaagaaaacatattatgtgacatataatatatccaatgctcaagaaaacactagaattaagtcggttgatgcactctctagtttttctttgaaatcttttgaaggagttcaaatttaatgacagaacaatatagtataggtgtaattagaacaaatatagataagttaagttttaatattatgaatgaaaatgaaaagcaatcacctgaaaaatccaagggagagttaactatagatcggttaaaaaaagaaattgatgataacagtattgcagtcaaggctgtgatgccgtttgataaaagcggtgacggattttctatcagaatggaagtaattggaatatttgctattcctaaatcgttggaagttgtattactgaacgaagatgtaaacaatcctgaattaaatgaactggtgtcaaggctatcgaaggttttgataaataaatttaagttagtaactgcacagctttcattagaagtaaataattttccaattatcccggaaatgagttttgattcagaagaaatacaaagaactaagtgattatttatttggtctataaattgatgaacacgtgaattaaaaaaattccgcactaaccttaattggtcggtgtaggattttttttaaggtttacaaaaaaggtgaaaagatgtaaaactggaaaaatgaagcaaacagatgcaatgttaacactttgccctttagtaaaaaatgtaaagtcatttataaaatcccacactagccttaaatggccggtgcgggatttttttgtgtttaagataataagttggtatataatagtggaaaaagcaaaacatcaaaaaaagggccaatattaaattaatttgtgctcttccacgatttgtaaattaaaaatctctctttttcagaaatggcttataaatggcatttatagcgtgctacccttaatggtataactaccgtgcgggtgataagtcgacgtcggtagataaaaagagaagcgtcataatgctggtatatcagcattatgacgcttctcttttgctaattggtatcaaattaaaaccccaattttgcgttttggctgttgtgatcacaacagcactgttaagcgctcataaaaaagggttttgggatcgtgtcacaagtaagggtcctatgaattaattattactcgttaatagtgtctgaaaggccgttagcgacattccaggtacgacccgttgtcgagtgagattgtatgggttctgtgtgctggtggcgatgccaggtgccgttgatagggcatactgatagccagcctgtttatcggctttaatggtctgctgattagcacggccggctgggtaacaaataacttgtgtgttctgttgtaaattatgatcgagccattttttggaacttgataattccgtaagttgaacctggtaagttaaattatttaaatccagatggcgaacggtgtgactttgaaaatcaatattaccggatgcttgcatccgcttagcatcagctaaagttaagtggtttttcttatgggtaaagccggtaataaaattaatggtggcgtgttggtgcgtctgtttcaaaattggccaagctgctgtcatgttatctttatagctatcgtcgagtgtgatccagacaatcttcttttgtggaattcgccgatgtttgagcgcgtatacggcttcattggcagtcagcgttcggtagccgtgtgcctttagataagtcatttcagtttgaaattctttggcggggacacgtaactggttcccgctagaaatactgtgatacatcaaaataggcaagtgaacatctttgacggtatgccaatgttgataaggccgtgcttgtgcttggtgtttagccgagctgtgaacgcttttagcgctagtcttagatgattgactgctggcttgtttagttgccggtgaagccgcctgacagcctgctaacaggccgagcgcgacgccgagacctaatacaaagttgataccccgcatgtgcatgataaatccccccatgatttaaaaactacttcctattctaatagaatagcatgcaaagcgcgataattattgaattattgttaaaataatttccttaatgtttaaggaaaatcgaatttgattagtaatcgtttaaactgattaagaaagcctagttagggtagccagaggagctttactccgatacgattaataaaataattaattcgggggatagtatttatgaataaaaaaagggctatttggttggcggcgattattatgatgattagtgtaggtacattgttaattgtaccgacgatgacgaagaatcaggggagtgagctggcaatggcggtggataacttaaacccatttgttaaggtacaaacggtctatggtcggactaatcaggcaatcggccactcgactggtcagatgggcgaagatatctatacctatcgaatgctgaccagcgatgcgcaaggtaagcaacgctggttgacatttaccgcagatcaccggctaaagcaacgacactatttaaagattgagacgaagggacaaaacgtgaattcatgggaggccgttgcgacaaatcaggtacctcaaaatatacaagaagtattggcttaaatttaggcatagtgccgtgtcagcgattagtgacgcagcactttttttgtgttattacgaaggcgagcttaataaattcttaaatccttttgagtgctaaactgcgatgagtgcgttacaatattttacgtgagacttgtaaagatggttgacaaaaggaccatttttagttagattaagatactgcattattatgtaataatgaatgaaggggagcgtgcaaatgcttaaaatagcaaagggtcggatttcgtatcccgcggtaatcggtgcggtcttatttatgatcgtgcaagtgattgcgaccttaaatctgcctagtttgacatctaatattgtgaataacggggtggctactggtgacattagttatatctggaaaatcggatttgaaatgattggtttttcattgttatcagtcgtcgcagcgtttggcaacgtctttttggcggcgcggtcatcacaacaattagggaagaatttacggtcggatatttataagaaggtcatcaacttttcaaatgatgaatttgataaagttgagacgtcttcactaatcactcgaacgaccaatgacgtcgtccagattcaaaacgtggccatgatggcgttacgaatgatgattatggcgccaatcatgctgattggtgcaagctttttagcgtataccaagagtcatgaattaacttggatcttcgtggtttctattccggtactattgatttttattggtttgatcatggcgtttgcaataccgttgtttcgggcgatgcaaactaagactgaccgcatcaaccttgtttttcgtgaaggcttaacgggagtacgcgttattcgggcattccgtcaagataaatttgaacaggaccgttttgaagacgctaaccaagattacacgcacaatgcgattaaggttaatacgattgtggccttggcttacccggtaatgactttgattatgagtgggactaatgtggcaattgtctggtttggtggccaattgattagtagtcaaacaatgcaagttgggaatatgattgcgtttatgacttatgccatgcaagtattgatgagtttcatgatgcttgccatggtatttgcgttcattccacgggcggccgcttccgcttcccggattcaagaagtcttaagtattgaacctaaaattactgaccctgacaaggcagcaacgttaccagcgacgactgaacacagcttagaatttgatcatgtcaactatcgatatcaaagtgcggagcaattagcgctggcagatattgactttaaagcccattctggacagaccgttgccattattggtgggaccggttctgggaagaccacgctcgttaatttaatcccccgattctatgatattgagagtggggcggtcaaattagatgggaaagatgttcggcagttgaagttagctgatttacatcaagccgtttcgtttgttccgcaaactgctactttattcacggggacgattcgtgaaaatatgcaattcggtaacgaacacgcgaccgatgatgaaatctggcatgcgttagaaattgctcgttcaactgacttcgttaaagaagaaggcggcctggatgcacacgttgaacaaagtgggggtaacttctctggtggtcaacggcaacgattagcaattgctcgtgcacttgtcaaacaggcttccgcttatgtatttgatgattctttctccgcattggacttcaagactgatgctcaattacgggctgaattacgccaggataaacagattcaacagagtgtcgtagtcatcgtggcgcaacggattgcgacggtggcggatgctgatctgatcttggtcctagataacggtaagttagtcggcaaggggacccacgctgaattgaaagctaataatgaagtttatcaagaaattatgaagtcacaattacgagaggaggatcagctgtaatgagcgaaaagaatacgagttctactaagcctgcacgtcctgctggcggtcatggccccggtggtcatgctggactagttgaaaagcctaagagtttttggaaaacggcgattcgattgatgcgctacatgtcagaccggtgggtcggtttggcagtggtcatgatttttgccattgcttccgtgattttccagattcgaacacctaagattttaggtaaagcaacgaccgaactttataagggaattatgaagggggccgcgcaacagaaggctggtatcagtcaatccggttacccaatcaactttgaaaaaatcggtcagattattatgatcgttttgatcatgtacttggcctcagcactgttcaactttattcaacagtacattatgacgcggatttcccaacggaccgtgtataagttgcggcgttcatttaagggtaagatgcaaaaggtgccgatttcatattatgatacccattcgaatggggacattatgagtcgggccgtcaatgatatggataatattgccaacacgttgcagcaaaacctaacccaagcggtgacaagtaccgtcacctttgttggaaccttatggatgatgctgacgattagttggaagctgaccttgattgcactcgttaccattccactgagtgtcgtggtggttggtgtgattgcgccgaaatcacagaaattcttcggaacacagcaaaagagcttggggttgttgaataaccaagttgaagaaaactatgctggacacgtggtcatcaagagctttaacaaggaacaagatgccatcgatgattttgaaatccaaaacaataattattatcaatcagcctggaaagcgcaatttatttcaggtattatcatgccactgatgatgttcttaaataatattggctacgtctttgttgccatcattggtgggattgatgtggctaacgggaacgtttcgttaggtaacattcaagcgttcttacaatacacgcaacaattttcacaaccgatttcacaaatggcgaacttgttgaacacgattcaatcgaccgtggcttccgctgaacgggtctttgaagtgcttgatgaagaagaaatgaaacagacgaaatccaacttaccagccgaaccagatagtgataacttgattagtctgcaacacgttcaatttggttatgcggataacgacctgttaatgaaggattataatctggacgttaaacgtgggcaacaagtggccatcgttgggccaactggtgctggtaagacgaccatcattaatttgttggaacgtttttatgacatcaaaggtggttctattaaattgaaagggaccgatacacgggacctggatcgtgaagacttgcggtcacactttgcgatggtgcttcaagatacctggctctttactgggacgattttcgacaacctgaagtacggccgtgaagatgcgtcagatgaagagatttatgctgcggctaaagcggcccatgttgatagctttgttcgcaaattgccagatggttatcagacggttctgaacgaagaagcttcaaatatttcacagggacaacgccaattattgacgattgcccgggcgtttgtggctaatccagaaattctgattttggatgaagcaacgagttcggttgatacgcggactgaagtgcatattcagcatgccatggaacgactcctgaagaaccggaccagttttgtggttgcgcaccggttatcaacgattcagggtgcggacaacattattgtgatgaaccatgggtcagtggttgaaactgggacgcatgaacagttgatggctcaaaatgggttctatgcggatctatataacagtcaatttactggcaatattagtctcgactaaaggaggggtgtcaattgttccggaaaacagcaatggttgccgttactgcgggtgcgctaacgttcttattagcgggctgtggtaagacaaccttatcaacgactaaaaccacatacaagccgaacgggttagtagcgaccgtcaaaggaaaatccaacgttaaaaaggttcattatcagcttgacggtggtcagacgaagacggcgacggtgcgtaatcatacgtttgttattcaagttccgaccaagacgacccgccaaacggtgaagattaaggccggttcggataccacgacggtgcacgtaaagggcgccaagaagctagttggctatcaaaagatggcgacgacttacaatcaggctttgattgcttctaaactcagcaagtctgatcaacaggcggctaagaagttgcaaactgagggtgcagcccttaaaaagcaacaagcaacgatccaagccaaagtcaagcaagcccaggcccaaatcaaggctggcggtacggcggctgccacgggtgctaagacactccaagcccaacaaactgctgcggcgcagctcaagaccaaagcagctagtttgcaaacgactcagaagcaggtcgaagcggcaatggcaacggcgaaaaagcaggtcaagtcgcaattgttaccgacgaagacgccaagtgatggcatcacgaacgtgttaacaactaaggattataagatccggctaaatgttcagaagggtgacgtattaggggcagcgatgattgttccaaccaaggcctttaagaacaagacccgccagaagaactttgggacggcgtttgctttgatgacgacaacaacgggcgccaatgccaagaaggttatgaaacagttccagaaggaaaccaaggataatagtggtagtacgacgacaatcgatccgattacctctaagggcgttcgcttcacgattggtgtctccacgtctgacttgtatatctttatgactaagtaatgttttatgagcgcgactggactttgattagtcaagtaaagctcactattcgaggttatgacgggacgaacccgtagttctaagtcggctgcattttacgcttgtaaagtaatcaaaaaatcaccacctggatgaacataatccaggtggtgattttttgattgatccattttaaatttgattccaaatagaccgtaaaggttacgtgcgttaaattactcaaatgataactctaagaagtataagtgtttggctggtaaatgggccgaagaaacccacacttcatggtagttagggacttttttctctgtgtaatcgaagaagaaatcaagtaagttgccgtttttagcgacaaagtcatcctgaaatcggttgactaatagcttgttgtcaggaaaataaatttcggggttagcgaccttaatatgatcggggacacccatccgaacgacattcgtgtattccggttgggtaaactgaatttcagtcgggtgatgggtgatatagaacatgacgttataaattgaatctgaattactagccacgacaaaccagtcctttgctaaatttacactcattataccaaaaaaatcttaaagcgttggaaatgtttgacgggcccttgacaaacttctaattaaccattaatcttttaattaaattcaaattaattaatttggaaaattacatataaaggaagtcgaagcatatggcagacgtacaattagactggaacaacttggggtttgaatatcggaatcttccgtaccgttatcgtgcgtattggaaagatggtgcttggtacaaaaaagaattaacgggagatgcaactttacatattagtgaaggctcaacagcattacactatggtcaacaagactttgaaggcttaaaagcttaccgcactaaagatggtagtgttcaattattccggccagatcgtaatgcagcccgaatgcagaccagctgtgaacggttattaatgccacaagtgccgacagacatgtttgtggacgctgttaaacaggttgttaaggctaatcaagattacgtgccaccgtatggaactggtgcgactttatacttacggccattgatgatcggggttgggggtaacattggtgttcatccagctcaggaatacatcttcacggtctttgcaatgccagttggtagttatttcaaaggcgggatgacgccaaccaactttacgacgtccgaatatgatcgtgcggcccataaaggaaccggggcttataaagttggtgggaattatgcggctagcttattcccaggtcaagaagctcatgccaacggtttctccgactgtgtttatcttgacccggttgaacatcgtaagattgaagaagtaggttcagcgaacttcttcgggattactaaggatggcacttttgtgacacccaagtcaccatcaattctaccttccgttacgaaatattcattactctacttggcagaacataaatttgggatgaagactgaacaaggcgacgtctacattgatgatttagaccggtttgctgaagctggggcttgtgggacagctgcggttatttcaccaatcggtggcttggaacatcaaggcaagttacacgtgttctacagtgaaacggaagttggtccggtaacgaaaaaattatatgatgaattaactggaattcaatttggcgatcgggaagcgcctgaaggttgggtccagaaagttgaattagactaagtacagtgttgtttgtgtgaataaaaagacggctttagtaagacccgtgatacgggtggaactaaagtcgtttttatgtgcgtgcgcatgatgcacgtggtattgtgaatagtaagaaatgctgtctaatcagtagacgcatgatcggaacgacagttattcggctaaggggacgttacggttaggttaagattgctgattgtgatgtaaagttgctgaagaaacgctaaaattaaagggagttgggcaagatgataaagtggagtaatcgacattggcaggcagttgaatgggtcagcacgggaattttggtgggctgtacgttactgtataatcatcaggttgtctcgaatcaatggcttctcgtcattggcggggccgctttaatcagttattggttggtcacattaccgcggttattcggaagtcagcactagcttcgggcaggtcgttgatgcaatcaggtcagttcgtatccgcagaaattgtcagggtaaaacgtggacactttgccaggttacttggttgatactgaccttgaaggcggtttagccacagtcaatcccaacttgaatcatgatcctaataagagagaatgaataaattaatgttaacttttagtagaaccgcagcactaattaaccaaatggtccaagatcaagtgatcccaggggcgagttatgccttgattgatggggctgagtggcacacgaatcaagtgggcgtcgctcaaataaaaccaacgatcaaaccattatggccggatgcgatgtatgatttagcctcggttactaaggtcgtgggaacaacaaccgtggcgatgcagttgatgcaaaatgggcaacttgaaattgaccgccccgtgcatgactatctaccggctttacagtccacaatgattacggttcgtaatttgatgacccatacaagtgggctgagtggttatattccaaatcggaatgcgttgtcagcggatgcgttattagccgcgattcagcagctaccaatcagtgagcgtaaccgcaatcatcgggtggtttatacggatttaggcttgatcatcatggggcaagtcattgaacgaattcttggagcggccattcagccaattatcactgagcgcgtcttgcagccattagggttggcacacacgagttttcaacctcaactagcgcaaaccgttccgacgacgtattctgtgaaaactgggttgttgcgggggatcgttcatgatcctaaggccagagtcttaggtgaacactgtggttccgccggtttatttgccagtgtgacagaccttgttcggttttcgcaactgatgcttggccaaatcgacgtaccagctgtgctatcacaggccacgattgcaagcttgtatcaagattggacgcccaatcaacacttacgccggagctttggttggaacctctggcaccgttctaatgagacgctgccggtgatttttcatactggttatactggcacgctcctgatgcttgaccgtcaacggcaacggggccttgttttcttatccaaccgggtgcatccagttgcaaataattcggtattccttccagcacgtcgccggttaattgcggcttggttggcggatacggttacaaattagctacttcggtttcacaaccgctttcatttatgctaaaatttagatattaaattcaacaatggagtgagtagatcttatgagtgagccatactttttaaagccggtgttccatgaaaaaatttggggcggtaccaaattacatgatgattttaattatgatattcccagtgatcatactggtgaatgttgggctatttcagctcatccgcatggtctagcgaccgttgaaaatgggccgtacgctggcatgacactggatcgagtatgggcagaacatcgtgatgtgttcggtgatgctaagggagatgtcttcccactattaacgaaaatcttggatgctagtgaagatttgtcggtgcaagtgcatcctgatgatgcgtacgcggctgaacacgagcacgaacttggcaagactgaatgctggtacgtgattgcggctgaaccgggtgcaacgatgatttatggtcatcatgcgaagacccgtgaacagctcgctgaatggatcaacaacggtgaatggaataagctattacggcgagtgcccgttaagcccggcgatttcctttatgtcccatctggaacgattcacgccgttggtaagggaattatggtgttagaaacgcagcagagttctgatacgacttaccggctatatgattgggaccgggtcgacaagaccactggtcagaagcgcgagctgcatttgcaacaatccattgatacaactaacgttccgcatcatgaccctgatcttgacatcacgactacccaggttggggatgcaacggtgaccaaatacgtccaatcaccattctttggtgtttggcaatggcggctaacaaatgggcaagcaacttttaaccggggaacagcaccttatacgttagtctctgtacttgatggtgaaggtagcattgtcgttgacggtcaagactatccattgagtaagggcgtccactttatcttgccatttgacgtaaaacaatggacattgaaaggcgatttacaaattattgcttcagaacctggggctaaggcataattagttaaccccttgatgggataaaaaagattgatactggttggaagccaatatcaatctttttttgtgcatctactgatagtatcagtttattaataatcactatctgaaagtatataaatatttattatagcttgaaggggtttactaatgagaaggcttccaaaaaactattatcattgtaaccaattaatacggatcaaactaaaaaaatcgtcactggctggtaactaagtcagtggcgattttgagtgatacgttttaaggtttcacgatgacgtttttagtgaggtcttcgttgagttgatccagtgcatcgaagttgccttcagggtacttacgttgtaaggccagtttcaagattcgtttggcgagggcttcattgcgtgcaaggattggaccatggaagtaagacccaaaggtgttcttgtagataacgccctcagattgatctttgccattattgccgttaccttggagcacttgaccaaggggccgttcaccttcgcccaggaaggtcatcccgttgtggttttcaaaaccatagtaggtctggtgggtttcggcgttctcaatggttatattaccaataaagcgattgttatcctgactgagcgtgtaatgatctaaggcaccgatacccgcgatcttttcaccatgggccccaatgtagtaatggcccagcatttgaaagccaccacagattgctaataatgggccaccggcttcgatatatgcggtcaaggcgtcttttttcgtttgtaaatccttggaaacaatcgtttgctcgtaatcttgaccaccgccgaagagggcgaagtcatatttttctccgtcaaacggatcatccaagctaactaagtcaacagtgatgtcggcctccactgctttagcatagtaacgcattgctaaaatgttaccgatatcaccatacgtgttcattagatcgccgtagaggtgtgcggcgtgtagtgtataagtcatggttaagccatccccccatcgataatgccttggctagcaagttgttttcgtaattgtaacatcgcggtgtaagttgcgacgacgtagacttgcttggtcggtagtttttgaattgcggtcgtcatgttggtcaggtcaggaataatggttaactgatcttccggtacgccagcaacttttagccggaacgtgatatcacgataacgttcaccgccactaatataggcgggaatattcaatgccggtaatttttcaaaattaccatcccagatccaactagtatcaataccatctgcatagtttgcgttgagcagggcggcaaatgagaatggccggtcatcggtgctgattgtttgcaagacttggttaaggcccactggattcttgacgagaatcagtgtgacgtccttttcgccaacgtgaaaggtctcttgacgaccaaagacttgttcatcgttgtcgctaagggcgtgcgcgattttggccggcgtgacgtccatgaagcgcccaaccgcgtaggcagctagcgcattataaatattgtattgaccaccgatattaagatgcatggcctgaccgttgatttcaaagtctgagctagtcggtgtcatagcggttaggacgtttaatttgtatgtcaactgtggacgctcaaaaccgcagtggggacaataatacttgcccatattgctataagttcgactatggtaacgcaaaatatgctgacaacgcggacaaagcaggccatccgtatttgctggcgcttgttggtcatggtcgggctggtagtcaaatccgtaatacagtatcggattaggcaattgtttggcattgaagagtggcaaatcaccgttggcaataattgtcgcttcaggtgctaaagcaaccccgtctaagattttttgatatgtcgtgtagatttcaccatatcgatccatctggtcacggaaaatgttcgtgaagacaaaggcttttggtgtgatgtacttggtgaccatgattacgttagcttcgtcgacttctagaactgcgagtggcttttggtgcgctttaggtgcccgtaaaaaggtcgtgacgataccttgcttcatgttggatccgcttggattggttaaaatgtcagggtactgttcacgtaaaaccttgaccgtcaaggcggtcgttaacgttttaccgttggtcccagtgatgacgatgacgtcgtagtttttagcgagatgctttaaaatcgttggatcgagcttcagcgctaacttgccggggagtgagctcccaccgccacggaaggtgtgtaaaaaccaatatgcggatttacccgtccaggtggctaatgtactattaattgacataagttatcggtacccctaattcttgatttacctgggaaatgatcagtgtgaccaactaccgggtattaaaatcataattaccggacaaaatgtcctactctcaagtattttatactgaacgtccctaaaagaaaagtgatactcccgccatttaaccgcatattatcaattcgttaattagttttaatgacagaatgctgaaattcacggccaaatccgctataattgactagaaatgtgtaaaaaaggggaatgagtcgcttggcacagttattttttcgatatggcgcgatgaacagtggtaaaaccattgaaattttgaaagttgcccataactatgaggaacaagataagtcggtcattatcttaacgagtggcttagataatcgtgatggtgtgggctatgttgcgagtcgcattggccttaaacgtgaagcaacgccagtatttgatgataccaatatttttgagatcgttaaacaaacgaatccggatgctgcgtgcgttttaatcgacgaagcccaatttttgaaaaagcatcacgtcctagaattggctgacattgttgatgagctaaagattccagtgatgacgtttggtttaaagaatgattttcgtaacgaattgttcgaaggtagcaagtacctactgctatatgcggacaagatcgaagaaatgaagacgatctgctggttctgtcgtaaaaaagcaattatgaatttacggttccacgatggtcagcccgtttatgaaggcgaacaagttcaaatcgggggtaatgaggcgtactacccagtttgtcgtcatcattatttttacccgccgaaattaacaaagtgaggattaactgagaatggataagttttttgataagttacaagccgttgccgatcggtatgaggaactcggtgaactattaagtgatccggaagttatttcggattctcaacgtttcatgaagttatctaaggaaatgggtaatattcgtgaaacggttgaaaaatataatcactacaaggaagtcacgagtcagatcgaagaaaatgacgaattgcttcatgaaaagctcgacgatgagatgaacgcgatggtcaaagatgatttaaagaaccttaacgcggaaaaggatcaattggaacatgaaatcacgttattgatgttgcctaaagaccctaacgatgacaagaacatcatcatggaaattcacggtgctgctggtggtgacgaagctagtttgtttgctgcggatctgttcaacatgtactcgaagtacgcagaacgtcaaggctggcaagtagaagtggctgatcgtaatgaaactgaagttggtggctttaaagaaatcgttttgatcatttctggtgacaaagtctactctaagctgaagtatgagagtggcgcgcaccgggtacagcgggtgccagtgactgaatcggctgggcgggttcatacctcaactgcaacagtcggcgttatgccggaagcgcaggatgttgacattgatattgatcaaaaagatattcggaccgatgtctttcgttcatctggtgctggtggtcagcatatcaacaagacgtcttcagcggtgcggatgacccacttaccaaccggtatcgtggtctcgatgcaagaccaacgttcgcaacagcaaaaccgggccaaagcgatggaaatcttgcgggcacgggtctacgactactatcagtcacgggaacaaaacgaatatgatgctgaacgtaaatcagccgttgggacgggtgaccgttctgaacgtattcggacttacaattttccacaaaatcgggtgacggatcatcgaattgggttaacgctcaacaaacttgaccgggtgatgaacggcgagttagacgaagttattgatgccctcgttttagctgatcaagctgaaaaaatggagcgcttaactaatgaataagcccactcaacccacttattttgaagcccagcagtgggcttctttttgtctaaaaacggcccagttgccgactgatagtgctcgcttcctgttattgggcttgagtcggctagaccagacacaattactcattcgttaccgcgagccgctacccagtgctgtttggcatgcttatcagcaggggattgaccgggttgttgctggtgagccagtgcagtacgtactcggagacgcaccgttttatggactcacgttacaagttgatccagcagtgcttattcctagagtcgaaacagaagaattggtagactggattttgacggatgtcccagcgacagcgccagttcgactcttagacgttggtaccggctcgggcgccattgcattggcaatcaaacacgaacggccggcatgggagattacggccagcgacatttcaaccgctgcgctgcaagttgccaaagccaatgcggaccgcctacatttagatgttaagctggttcacagtgatctattgaccagcgtatctgcgcagccgtttgatattattgtcagtaatccgccatacatcgctgcgagcgaaaaagacgtcatggacgccagcgtcctcgcccacgagccacaaacggccttatttgctgaccacgatgggttggcactttacgagcagttagcgacgacggttgccgatcatctgacttcgaccggtcgcttatacttggaattcggctaccatcagggaccggccttgcagacgcttttcgcgcagtcgatgcccgacgcgaccgtgacgctgcgacaagacatggcgggtcacgatcggatgctgcgagttgcaatgactctgactcggcaatagttgcgcgttatcctggagaatgctgataaaagcgggccgattaggtagactgctgtttgtaatccgcgtcccattccggccttcgggggtgggtgaacgcagtcgtcgatttgagctcgcgcataacccgcgttatctcaaatgtgagtcttatcctaagcgggctgtttttaacctgggaggtacggcgtgaatttatgagcaattgattaagtccgtgatgtaaataataaataatattatatgaaagtaacgatgaattaataataaagtagaggtttgaatatattatggaaacgaaagtatatacgccggcggagattccggccgctgcggcgttgttaactgcggggcagttagtggcattcccaacggagacggtctatgggctaggtgccgatgcggcaaatgtggatgctgttaagcaagtgtacttagctaaaggccgcccgagtgataatcctttgatcgtgcatgttgctgatgtggaaaccgttgagcggtttgctcaaccgttatcggaagcagccaagaagctgattaaggcgttttggccaggccccctgacgatgatttttaaattgaaaccagatgcgttggcaccagaagttactggtgggctgcagacggcggctttccgtaatcctgataatgaggcaaccctggctttgattcgtgcggccggaacgcctatcgtgggaccatccgctaatacatctggtaagccaagtccgacgacggcacaacacgtattgcatgatctacgtggtaaaattgctggtattctggatgatggtccgacgaaggttggcgttgaatctacagttctggatctttcaaccgaccaaccagcaattctacggcccggtgccgtaacgcctgaagcaatcgaacgggtcattggcatgccagttcaaaccgaattgcaccatgtcggagctaaggaagttcctaaggcgccggggatgaaatataagcactatgcgccaaacgcacaagtttatatcgttgatcgttcggaagattggccagaagcgctggcgtgggcagcccagcaagatgtgccaatgggcgttatggcaacagatgatattttaactaacaatcaaattccggctaattgcgaacaattttcgcttggagaagatattcaatcggcaagtcgggagctgttcgcgggcttgcggcactttgatactgagacggaaattaaagatattctgtgccaagcctttgaaaataaaggacttgggcttgcctacatgaaccgattaaataaatctgccggtcagactcattttagtgtataatgattgcaagtcgggaaaacccgaaagttgtcacttgcgaaatggaggagatttattcatgaattaccaggaacaagatccagaagtatgggctgcgattagtaaggaacaggcacggcaacaacataatattgagttgattgcttctgagaacatcgtttcaaagggcgtccgggcagcgcaggggagtgtgctgaccaataaatactctgaaggctatccgggtcaccgcttttacggtggtaacgaatacattgaccaagtggaaaccttagccattgaacgggctaagaaattatttggtgcggaatatgctaatgtgcaaccacactctggttcccaagccaatgcggctgcatatatggcactgattcaacctggtgaccgggtgatggggatgtcactagatgctgggggacacttaacacatggatctagtgtgaacttctctggtaaactttacgattttcaaggttatgggctcgatcctgaaactgaagaattaaactatgatgcaattcttgcacaagcacaagattttcaaccaaagttaatcgttgcgggggcttctgcttatagtcggttgattgatttcaagaagtttcgcgagattgcggatcaagttggggccttattgatggttgatatggctcatattgccggcttagttgcggccgggctacatcctaatccagtgccatatgctgatgtggttacgacaacgacgcacaaaacgttacgggggccccgtggcggtatgattttagcgaaagaaaagtatggcaagaagatcaactcggccgttttccctggcaatcagggtgggccgttggatcacgtaattgcgggtaaagcgattgctttgggcgaagacttacagcctgagtttaaggtttatgcccaacatatcattgataatgccaaggcaatggcgaaggtcttcaatgactctgacttggttcgggttatttctggtggcacggacaatcatttaatgacgattgatgtcactaagtctggtttgaacggtcgccaagtacaagatctgttagatacggtttatattacggtcaacaaagaagcgattccgaatgagacgttaggggctttcaagacctctggtattcggttgggaacacctgcgattacgacccgtggttttgacgaagctgatgcaactaaggtcgctgaattgattttgcaagcgttacaagcaccgacatatcaagcaaatctagatgacgttaaacagcaagcaatggctttaacagcgaagcacccgatcgatgttgattaagtaatttatatcaggtctggttttttctctctaaattagctacaatagaaagaaatcactaaggagtgtgcgtagcaacatgggtaagtttgaggttttggatcatccgctcattcaacataaattgacgatcattcgggaaaagaactgtggtactaaggtcttccgggaaatggttaatgaaatttcaacgttgatggcgtacgaagtatcacgcgatatgccgttgaaggacattgagattgaaacaccgattgccaagtcaacgcaaaaaacgttggcaggtaagaaagtcgccattgtaccaatcttacgggctggcttagggatggttgacggtttcttaaacatgattccggcagctaaagttgggcacgttgggatgtatcgggatgaaaagaccttgaagccggtcgaatatttcgttaaattaccaagtgatatttcacaacggcaattatttgtcgttgatccaatgttagccactggtggttcagccatcatggcgatggatatgttgaaaaagcgcggcgcaagtaatattaagtttatgtgtttagttgcggcgcctgagggtgttaaggcacttcgggacgcacatccagacatcgacgtttacacggcagcacttgatgaccatttaaatgaagatggctacatcgttcctggtttgggcgatgcgggcgaccggttatttggtacgaagtaagttgcattgacaaaaggtagcaccgccaggcaatgtctggggggttacctttttgtttttcaaaattattaacaactttagctataatcatccgcattctgtgagttcattagtcatgaatcgtgactaaaacgtgctaatttctaagattaaaagcagccagttatggaccactggaaacgggtgtaagtgggcgtaaacatgctttgctggttcgtcctaagccgacttccagtcgtgacagtgttcgaatggctgacgaagatgtacctaacttttgatgaatttgtcgttgctttttacaaccagtaattttgtcaatcaactggcagactgaaaatgatattgagatagctcactaatcctgaattggtgtagtaaaatttaatctcttgacaaagtgctaatgcacctaacgctttgtttaaagttccagtgtcaaaatagtcagcgacaaattgtaccaagttaagtggccgttcatcagccatttgagcggcttaccgaccggaggggctgggtgacaatgcccagtagccaaattattcttagctggaagtggtctgcttccggcttagaataagactcgtatttgagatgacgcgggttatgcgttagctcaaatcgatgtcggctgcgttccagcaattgtcacccagccccggaggtcggaataggacccacaccggctgacgcacaacaatctaattagcacgttttaatcaccgttaatgccaaataataatttgtacaatgcgtatattataggtagttattgacattaactgttgggggacactggataattagggtgttttagatggcgattacgctgtattggtcgaatattcggtaacgttgggtgagaaagtcacattatttcaggaatgttgtcacaaatattatgatgttttgaactaatatcgtttttaggggctgctactggttcggttcaaacattgagttgacaattatttcggagacgagtagactaattgcaattaaacagttcctttaaattagctcagagaggctgaaaaggatgaacggacgtgcgctttcaaggaagccgtgcgtaatttcggacagcctagccgctttgagtggtgggctgtcttttcttttgcaatcattcataaaaaggggtgcgttatgacaaagaaagcggcgtttcataatgatgaagtcgtgttagatattcatgaccgaccaaaattaggtagttggttaggcttgtcggtgcaacatctgttctcgatgtttggttccacggtattggtgccaatcctggtgggattaaatccaggtattgcgctgtttagctctggtgttgggacgctaatgtatatcctcatcacgcgcggaaagattccggcgtatatgggctcgagcttttcatttatcgttgtgatgcagtctctgatgaagaccgcaggatatccggccatcgctcaggggactgtcgcggtgggctgtgtgtacctgctagttagtttattagttactttaatcggttctgactggatcgataaggcgcttcccccgatcgtcgtggggccgattgtgatggtaattgggttgtcactcgcagggacggcagctaaggacgcaacgattaacgggagtagttatgatattaaatatttcggcgtcgcgatggcgacgatgttactgaccgtcatttttaacatgtacttgcgtggatttatgagtttagtaccgatattgttgggaatcgtctgtgggtatatcattgccgtgttagttggaatcgttgacttttctggtgtggaaaaagcgcagtggtttgcgatgcccgcctttcaattgccttttattagttatcatcctggcatttattggggcgcgattctgagtatggcaccaatcgcctttgtgacgatgtcagaacatatgggccatattatggtactcaataagttgactaagcggaatttcttcaaggatccaggtttgaaccatacattggctggcgacgggacagcctcgattatcgccggctttgtcggtggaccacccgtaacctcctatggtgaaaatattggggtgctggcaattacgcgggtccacagtatttatgtgctcggtggggccgccttttttgccatcgtctttagttttgtgggtaagttatccgcgttgatcgagagtattccatcacccgtcatcggtggggtcagctttctactgtttggggtaattgcttcaagtgggatgcgaattctgattgataataaagttgattttaatcagaagcgaaatttaatgattgcatcagcgattttggtcattggaattggcaatgcctatttacaactgggaagctttcagttcagtggtctagcagttgcaacggtgctcggaattgtgatgaacttggtgctgccaaagacggcggtaaatgagaagtaggccgtcattgcgcgtgctaagaatgaaaataaagtcaaaataatgaaaatccaacgatttgaaagcttaatgaaagcttgatattgttggatttttattgattgacgaaatgttgaaattattttgaattttttcgacggtggtggtattattacctttgtattttgattaggggtgtctctaatctaccatttcaggttacgataaaattgacgttgactagctcaaaggttaaggttatcgtagcaccgaaattaaaggaaagaggtgatattcagtgggtgatccagttcctacagtcaaagttcttgggttgacatttaatgtcgcaaatgacttgtcaatattgttgacttgtctaattgtttttctatttgttttcttcctatcgcggcatattggaatgaagcccaagggtggacaaaatgtgctggagtggctcatcgagttcacaaatggcattgtcaaaggctcaattaaaggaaatgatagcggtctgtttggtttatatggatttacgctatttctttttattttcgtagcaaaccaacttggattatttattcatattgaggttggtaagtatacgtacattaagagtcctactgctgatccaattatcacattaacgttagcgttaatgacaatttcatttgcacatttctttggtgttaaacgaaatggtttacaaaaataccttaaggggtttgcgtcgccattttcgttgttgttgccactcaatctttttgaacagtttactaattttttaacattaggtttacgattgtttgggaatatttttgctggtgaaatgctactaacgttaattagtggtattgctactggcaatggttggattagttacatctatgcactgccacttgaattagcatggcaaggcttctcagtctttattggtagtgtgcaggcgtttgtgtttgttactttaagttcggtttatatttctcagcaattagtgtctgaggattaaacatctgttttctattttaaggaggatattcaaattatgggagcaattgctgcaggtattgcaatgtgtggtgccgctattggtgctggtgttggtaacgggttaattatttctaagatgctcgaagggatggctcgccaaccagaattatcaggtcaattacggactaatatgtttatcggtgttgggttagttgaagctatgccaatcatctctttcgtcgttgccttaatggttatgaacaagtagttagcgacaaaaagttcattttgatgaaaatgaaagaaggaggtgtcattagatgttcacgcatttagttattggtgcatctggtctttatttgggtgatatgttatttatcgcaattagttttctgattttaatggctttaattgcaaaatttgcttggaacccggttttgaaaatgatgagtgatcgtgcaaaaaagattgctagtgatatcgatgaagcacaaaaatctcggcacgaagctagtgctctagctgatcaacgtcgcgatgccttagcacacgcacgctcagaagccagcgatattgtggctgacgctaagcagagtggtgaaaagcaacgcgcaacaatcgtttctgatgcacaaaatgaagcaactcagtacaagcaaaacgcacgtaaggatattgaacaggaacgtcaagatgccttgaagaaactccaatctgacgtcgctgatatctcggttgcaattgctacgaagatcattaagaaacaattggatcctgagggtcaacaggcattaattaattcgtatattgaagggttgggaaagcatgagtcttgataatcttacaattgcaagtcgttattcaaaggcactctttgaacttgcagttgaaaaagatcagaccgaagcattcctggccgagttaaagcaattacggcaagtctttgtcgacaacccgcaattggcagaggtcctctcaggatcattgcttccggttgatcaaaaacagacaacgttgtcaactttgactgaccacgcttcagaatacattaaaaactttattcaaatgttgtatgattacggccgcatgtcgaacttagttggcattgttgacgcgtttgaagcacgtttcgatgagagtcgcaaaatagtgcatgccgaagtaacgtctgcggtcaagttgtcagatgagcaagctgatgcaatcgcaaaggcattcgccaaacgtgttggtgccaatcaggttgttttgtcacgtaaagtcgatgaagcaatcattggcggtgtaattgtgaagtcaaataatcaaacgtttgatggtagcgttgcgttacaactaacgaatttaagacgagcactcatcaacaattagtttacgaagaggtgaaacttttatgagcattaaatctgaagaaatcagtgctctaatcaaacaacaattagaaagttatcaaactgagctctcagttgctgaaaccggtactgtcacctacgttggtgatgggatcgcccgtgctcacggactcgacaacgccttacaaggtgaattactcgaattcagtaacggagtttacgggatggtacaaaacctcgaaagcaacgatgttggtatcgttgttttaggggattttgatggtattcgtgaaggcgatactgttaagcggactggccgcatcatggaagttccagtcggtggcgccatgattggccgggtcgttaacccattaggtcaaccagttgacggtttaggtgagattaagaccacgaatacgcggccaatcgaacataaagctcctggtattatgcaacggcaatcagttagcgaaccacttcaaactgggatcaaggccattgatgccttagttccaattggtcggggccaacgtgaattgattatcggtgaccgtaagactgggaagacgtccgttgccattgatgccattttgaaccaaaaggaccaagacatgatttgtgtctacgttgcaatcggtcaaaaggactcaactgtacgggcccaagttgaaacgttgaagaagttaggtgcgatggactacacaatagttgtaactgccggacctgctgaaccagcgccattactgtacttagctccttatgctggggcagcgatgggtgaagaatttatgatgaacggcaagcacgttttgatcgtctatgatgacctttcaaagcaagcaacggcttaccgtgaactttccttgatcctccgtcgtcctccaggtcgtgaagcttatcctggggatgtcttctacttgcactcacggttactcgaacgggctgccaagttgagcgatgaattgggtggcggttcaatgacggccttaccaattatcgaaacgcaagctggggatatttcggcttatattccaactaacgttatttcaatcaccgatgggcaaatcttcttggatagtgattcattctattcaggtgtgcggccagcgattgatgccggggcctctgtttcccgggttggtggggatgcgcaaattaaagcgatgaagtccgttgccgggaccttgcgtcttgacttggcttcttatcgtgaattggaatccttctcacaattcggttctgacttggatgctgcaacccaagcgaaattaaatcgtgggcaacggatcgttgaagtcttaaaacaacctgttcattcaccattgaaggtcgaagaacaagtaatgattttatatgctttgaccaacggttatttggataaagtggcagttgatgatattgcccgttaccaaagtgaattgtttgaatttattcatgctagtcatcaggacctctttgatacgattttggcaaccaagaagttaccagaagctgataagatgaatggggccttagatgcgtttgcagaacaattccagccaaccgctgccgctgcgaagtagttatggctgaaaaggatggtgagtagtgcatggcagaatcattaatggatgtcaagcgccgaattgactcaacaaagaagactcatcaaattacgtcggcaatgcaaatggtctcaacttcaaaattgaaccagattcaaaagcataccagcacgtatcaggtgtacgcttctaaagttgaaagcatcgtttcacatcttgccaaagctcatctgatgtcagcaagtgccggtgttgctaacagtaattcgaatacgatttcagttagtgaattgctcgcgcaacgccccgttaaaaagactggtttattggtgatcacttcggaccgtggcctcgttggtagttacaacagtaacgtgttgaaacagactaacgatttcatgcggacgcacaaggttgatgccgataacgcagtcgttttggcggttggtggcactggtgcggatttctataaaaagaacgggttaaacgtggcttatgagtaccgcggcgtctctgatgtcccaacttttaaagaggttcgtgaaatcgttaagacagtcacatcaatgtaccacaacgaagtctttgatgaactttacgtcttctacaaccactttattaatcggctctcttctggttttcgggccgttaagatgttaccgatctccgaagagacctttgaacaaagtgagtcagataatcgtaaagccaaggatagccgggtagatgtcggtcccgagtatgaaatggaaccgtcagaagaagccattttgtcggccgtgttgccacaatatgctgaaagcttggtttatggtgcaatcttggatgccaagactgctgaacatgcttcgtcgtcaaccgcgatgaaggctgcatcagataacgctggcgatttaatcgataaattaaatctgaaatataaccgtgcgcgtcaagctgctattaccactgaaatcactgaaatcactggtggtttggttgcgcaagaataacgaagtgggaggaattaacgactaatgagtacaggtaaagttgtacaagttattggacccgttgttgacgttgaattctctctaaacgataagttacccgatattaataacgccttgatcattcagaaggacaacgatgacactttaacggtggaagtatcgttggaattaggtgatggggttgttcggaccgtcgcgatggatggtacggatggcttgcgccggggaatgacagttgaagacactggttcttcaattactgttcccgttggtaaagagacgttaggccgggtcttcaacgttttaggggaaaccattgatggtggtccagaattcggtccagacgcagaacgtaacccgattcatcgggatgcgcctaaatatgatgaattaacgaccagtactgaagtattggaaactggaattaaagttattgacctcttagcaccttatgttcgtggtggtaagattgggttgttcggtggtgccggtgttggtaaaactgttttaatccaggaattaattcataacattgcccaagaacataacgggatttccgtgtttaccggtgttggtgaacggacgcgtgaagggaatgacctttacttcgaaatgaaggcttccggcgttttgaagaataccgccatggtttatggtcaaatgaacgaaccacctggtgcccggatgcgggtggccttgaccggtttgacgattgcggaatacttccgtgatgttcaaggtcaagacgtgttgttattcatcgacaatatcttccggttcacgcaagctggttctgaagtttccgccttacttggtcggattccttcagccgttggttaccaaccaaccttagccactgaaatgggtcaattacaagaacggatcacttctaccaagaaggggtcagttacttcgattcaagccgtttatgtacctgccgatgattataccgacccggcacctgcaacgactttcgcccatttggatgcgacgaccaacttggaacgttctttgacggaacaagggatctacccagccgttgacccattagcttcttcttcaatcgctctggacccatcaatcgtgggcgaagaacattatcaagttgcaacggaagttcaacgggtcttgcaacgttatcgtgaattgcaagatattatctcgattttagggatggatgaattatctgacgaagaaaagacaactgttgcgcgtgcacggcggattcaattcttcttgtcacaaaacttcttcgttgccgaaaactttacgggccaacctggttcgtatgtgccaatcaacgataccatcaagggcttcaaagaaattcttgaaggtaaatatgatgacctaccagaagacgcattccgtcaagttggtaagatcgacgacgtggtcgaaaaagcgaaatcgatggtaactgattaggaggggtttacatggctgacaatgcaaaatcattaaccgttagcatcgtaactccagacggtcaggtctatgagaataagacgccaatgttgatcgtgcgaacgattgacggcgaactcggaattttgccgaaccatattcctgtgattgcatcgcttgcaatcgatgaggttcggatcaagcaacttgaaagtgatcaggaagatgacgaaattgccgttaatggtggttttgttgagttcagtaataatacggcaacgattgttgccgatagtgctgaacgtcagaatgacattgacgttgctcgagctgaaaatgcacggaaacgcgctgaaacacggattcaaaatgcccaacaaaagcacgatgatgctgagttggcgcgggcccaagtcgctttgcggcgtgccatgaaccgtttgaatgttgctcggcattaacaacttaaaattctgaaaagcatctgcaattatttgcgggtgctttttttgtgcggttcagttaagccgcgatgcacaagttagtcaaacttaccgcggtgagtcgtactcgttactgtccagttttaagcttgcacggttcaaagcagattggaaccgtgggttgatcaagggccaagcactggcttactaatggcgatatcgcgttgttaactagaagaatcggtctgattcgaatatttttcgccaacattgcatcagtatctggcagagcagtaattaagacgtggatcgcgacttaaatgggtgatcatcacattccgacaattggcagcaatttccaaaggtcggcatagggaacatgaacaactaagtttacatcgaacttaaacgtttcagtggccaattttatcgcgacgttgaaatgttttgtccagtcggcgcggatgttcgtgaactagattttactaatcgattgagcgtattaggggcattgcgataagttgaatggtagaatgcaacttatagtgagattacaataaagaaaacgattacaaacgaacgatactgctaatcaatatgggtatggcttgtcaaataattgcacgacggacttctaattagttaactaatcataagtatttaatatttgtgttgaaattgtaacgaaaatgtaaaatgtaatatttatccactagtgttctatggtatgatgattaggaaccgatttgaacctgcatgctgctattggcaagttgccatggtgtgtccaggttgttttgatggttgagctggtgtttggattgcacaccgcgcgttgccgatttgcttagtacagcggtgaacagtggaatttgggcaggtgcgaggcatctgatccaatcgggttcttttagtaagtgtgctttttacgcaatccgaaatctcacgtaacttgtttgttgattatcgtttagtgatggagggtttatccatggaggaaattgtagttcatggcggtcaacgtttgacaggaaatgtccatattgagggcgctaaaaatgccgtgttaccaatcttagccgcaagcttgttggctagttctggtcagacacatttatcaaatgtaccagtgttatcagacgtttttacaatgaacaacgtcttgaaatttttgaatactaaaattgattttgatgaaattaataaaacaattgatattgacgctagtcgtcaattatcatccgaagcaccatttcaatacgtatccaaaatgcgtgcttcaatcgtggtcatgggaccactattagcacgattaggccatgcgaaagtcgcgatgccaggtggctgtgcgattggttcacgaccaatcgatttacacttaaagggactgaacgcgcttggtgctgaaatcgaacgccacgatggctatgttgaagcaaccgcgaaccagttacacggagcggccatttacttagattttccaagtgttggggcaacgcagaacataatgatggcggcaacacttgcagatggcatcacgacgatggaaaacgtcgctcgtgaacctgaaattgtggacctagcgaactatttgaatcagatgggcgctaaggttaccggggccggtactgaaacgatccgcattgaaggggttaaagcgatgcatggctgtgaccatagtatcgttcaggatcggattgaagctgggacattcatggtcgctgctgcggtgactcagggaaacgtcttggttgaggatgctattgccgaacataataagccattgatctcgaagatgcgtgagatgggcgtcacagtaacggaagaaccggctggtattcgggtcattggtccagaaatcttgaagccaacctccgttaagacgatgccccatccgggtttcccaacggatatgcaaccacaaatgacaattttgcagttgtgtgcgcagggcactagtttattaactgaaacggtttttgagaatcgcttcatgcatcttgatgagttacggcgaatgaacgccgacttcaaagttgaagggcgctccgtcattatgtatggtcccactgactttaacggggcccaggtcactgcgacggatcttcgggcagctgcagcgttagtaatcgctggactggtcagtcggggttacactgaagtgactaatttgaagtatcttgatcggggctactttaacttccatggtaagctggctaaattaggtgctgagattaaacgagttgatgttcccgatggcaccgtttatgcgttgaatcctgattttgcgaacgaagctgcggaataaatcgaaataaatgcttacaaaaccttcaaagtgcgataaactcgtttttgaaggcttttttgtggcgaagcggggtaacccggcgccaacattcaggaggacaacttatgtttattaatattatcgacaaacacatttcattgaaaccaactgaagtggctgacgcggagccgcttttcgacttagttgatcataatcgcgaccatttgaagttatggatgccgtgggttgatgcgacggcgaccgtgcaagacgagcgtcattttatcgaatcaatgttgaccaagcaggctcatggacaggtgtttatcaccaccatcattgtggatggcgaagtcgctgggatgctagacttgcataatattagtgccattaatcacaacggtgagattggctactggctgggccagaaatatactggtcgtggcgtcatgactaaagcgctcgaacgattagaagaaattgcttttacggagcttgatctgcacaaggtcatcttaggtgcagacgttgccaaccaggcaagtcgggctgttgctgagcgacgccaatatcatttggatgcgaccctgccagaaaatatcttgttaaatggtcaatatcgtgatgaagcaatttattcgctgacggtcgatgagtggtcgaaacgacaggatgattaggcacagccaattgattggtagtgacaaatgaacgagtggctaggacagccgtcagttctcatcaactgtagagtatggtataatgattagtcgtataattgtatgtttgagaggagcaaaaacatggctttagatattggtattgacttaggtactgccaatgttttaatttacgtatcgggtaagggcatcgtccttaacgaaccatccgtggtcgctatcgatacgaacacgaatcaagtgttggcagtcgggtccgaagcctaccaaatggttggaaagacgcctagtaacattcgggcaattcgaccattaaaagacggagtaatttcggattttgatgtcaccgaagaaatgctgtcctattttattaaaaaattaaatgtccgtggcattatgtcgcggccaagtatcatgatctgtaccccaacgaacactactgaaattgaacgcaaggcaatcttgcaagctgctgaaaaatctggcggtaacaaggtttacttggaagttgaaccaaaagtggcggctattggcgcagggatggatattttccaaccacgtgggaacatggtcattgatattggtggtgggactagtgatatcgctgtcctatcattaggtgacattgtggcaagtagttcgttacgaatggccggcgaccggatgaatcaggacatcgtgaactacgtcaaagatcaacatcacttgttgatcggtgaacgcagtgcagaacaagttaagattcaaatcgcacaagttttcaagcaggacggcgatgatgataaggtcacccaagttcgtggtcgagatactgtgacggggatgccgcgctcaattgacattgactccaatcaagttgaagaagctattcacgaaacgctgatgcagatcgttagcacggcccatcacgtgatggaaactttaccaccagaaattgcggccgatattattgaccgtggaattacgttgactggtggtggcgcactgttgagtggcctcgatcaattgatcagtgaaaacttaaaggtgcccgtaatggttgccgaacacccattgaacaacgttgctcagggggctgggattttacttgaacatatgcagaaaactgctaagaacaagaaataaattacgatgcgacggttattaatgaaaggcatccgcttttatcagcgggccttttctgcgtttagtccggctcattgtcgctattatccaacctgttctaattacacgttagaagcgatcgatcggtttggcgcagttaaaggcgttctaatgggagttgcacgtatcttacgttgtcagcccttagttaagggcggctttgatccggtaccagcccatttttcattgcgtcgtaatccgcaatacaaggaggaagaccaccgtggcaagaaaagataaggcgatttcggtcactttaaacgaaactaaggtcaacggtcaaccagttaccgaagttttgatcggtaaacaagtgattggacaagtgactcaagtcggtgaacgatttgaagctgaaatggttagtgacaaccaaccatttgcgcataccaaatcttttgatgagagtctgcaagagatcttgtcggcttaccatctacacaaaggctaatttttagtaaaccttcaacctggttccgagaattcggcaccaggttgttgtataataaaaactatcttaaagtacaaaatgatattgtgaatagggttagtctgacgcgtgcggtgggctaatcccaacaggttaggagcgttatttgtggcagaagaatctagactccgcagtcaagacgaggattcaagaattgactggggtatcatattttcagtgatgatgctaggattgatcgggctggcgtcgatttatgtcgccgcagtgcacgactctagttcagtaaacgtcacgaagcaggtgatttctcaagtcatgtggttcgtgattgggaccgcgattgccgtaattgtgatgcaatttgattcggaacagttatggcgagtggcaccgattgcctattggtttgggatcttcctgcttgcggccgttttggtcttgtacagtagatcactgtttgcgagcactggggctaaaagttggttcgcagttggttccttgacgttgcaaccgtctgaagtcatgaagcccgccttcatcttgatgcttggacgagtcgtgacaatgcataacacggagcacccaacacatacgatggcgagcgattggcaactcattgggaagttaattgcgtacatggtgccagttgctatccttttgaagttacagaatgactttgggacgatgctggtgttcttcgcgattcttgggggcgttatcttagtttctgggatttcgtggcgattattggcaccgacgtttgccattgtggcggcgattgcggggactgcgttatatctcgtgatctcgcagagtggtcgccatattttggaagctatcggttttaagcaataccaatttgcgcggatcgatacgtggttgaatccgtcgacggacacgtctaacaatgcttatcaagtttggcagagtatgaaagcgattggttcaggtcagattactgggcggggatttaacgtttcccacgtgactgttcctgtgcgtgaatctgatatgattttctcggtaattggtgaaaactttggctttatcggttgtgccgtggtcattttattgtatttcttattgatttaccagatgatccgagtgacgtttgatacgaagaacgaattctacgcttacatttcaaccggggtcattatgatgattctcttccacgtgttcgaaaatattgggatgagtatcggactgttaccaatgactgggattcccttgccgtttattagtcaagggggttcggcgttgattgccaatatggctgggataggtttaatgatgtcgatgcgatatcattacaagtcctacatgttcagtcgtaacgaccggtttgaatagtaaaattattgtaaaggtatggtgtttagtatgagtgaagatgcagcttatttttggacaaaagacgttgatggacatacgcggttaggtttaactaaggccgcccatgaggctcttggtgaagtgaaatatgctgagttaccagctatcggtgacaaggtcagtcagaacagcgcttttctgagcgttgaagcgaccaaagccgtttctgaattcaactgtccaatcaatgggaccgtggttgcggtcaacccggcgttgagtgagaacttcgatgcgttaaatagcgttgaagacggcgttgcttggttaatcgacgtggactaattgccaggccttgacaattagaaacaggctcggtatactcgttacattaacaattgattaaaaaagttatcattttgaaaagatgagtacgcggttatgattacttagagagtccctgattggtgaaaggggattaatcgtgaagctgaagatggtcttgaagtaatgaagtttagtgagcagtcgcaagctaagcttgggtcgcacccattatcatgcggagttcaaagtaactcttgagacaactggcgtgagctagttgtgaagatgggtggtaccacgaggctaagcttctcgtcctattgatgattattgtcataattgtctgggatgaggagctttttttgatgcgtaaggaggaattgacttgattgaatttaaagatgtgacgaaaacctttgatgctaagcaaggggcggttcacgccgttcaagatgttaatttaaaaatcgaagatggtcacatttatggcattgttggctattcgggtgctggtaaaagtactctggtacggatgctgaatggcttagagacacccactagtgggtcagttgtgattgatgatgtcaatattacaacgttgagcggggccaagttacgcgcccaacgtcaaaagatcggcatgatttttcaacattttaatctattatggtcgcggaccgttttggagaacattatgtttccacttgaaattgctggtctgtccaaggtggatgcccgtaagaaagccgaacacttggcagacttggttgggttggccggtcgggaaacggcttatccgtcagaattatcaggtggtcagaagcaacgggtcgggattgcccgggcacttgcgaatgatcctcagattttactttctgatgaagccactagtgccctagacccgcagacaactgatgaagtgttggatctgttgttatcgatcaaccagaagctccatttgacgatcgtattgattacgcatgagatgcacgtgattcgcaagattgctgatcatgtcgcggtgatggaagctggtaaaatcgtcgaacaaggaccagtacttgaagtcttcaagcgaccacagcaggctgtgactaagcggtttgttaatgaagaggtcacgccgtcgctgaatgacacaacggtggtcgtggaccagctgctggcgaaatatccaaagggaaccatcgtacaactgacgttccatggcgatcaagcccagctaccgattgtttcagagatgttgaagaagtatccgttagatttaaatattattgagggtgggattcaccaaacccaagaaggggcgattggttcgctgtacttacaactaacgggtgatcaggaacagattaagggcgctctagcgtacctacaaacgatgcgggtggaaacggaggtcttgaaccgtgaatgatcaaggattagattcatattttaaatttgcaaatgtcgattggggtagcatgatgtcggccacgtgggaaacaatttggttgacgattgtgtcgatggtcgtagttgccattctcggaatcgccttaggtctgttactttatgagacggcggggagtcagaatccgctggctaaggccttgaattggattgttgcgctgttcgtcaacgttttccggtcgattcctttcattattttgatcgtgctattattgccggtaacgtctaagttagttggaacgattatcggaccgcgcgcggccttaccatcactgattatttctgctgcgccattctatgcgcggatggttgaattggccttccatgaattggatcatggagtgattgaggccgctgaatcaatgggggcgacccggtggcagattattcgaaaagtcctattgccagaaagcatgccggcattagtttctggaatcacggtcacgacgatttcattaattggctacaccgcgatggcaggagccattggtgctggtggtctgggtaatttggcctaccaagacgggtttcagtccaataacaacgccatcacattagtggcgacggtaatcattgtgattatcgtgtttatcttccaatttatcggggatattgcagttcggcatattgataaacgggttaattaaagttcgtataggaggaaacggaattatgaaaaaaaagggaattctaggattattagcagttgcggcaacggcaattttgttagtcggttgtgggaagtcatcgtcaacaaagacaacaaccattactgtaggggcttcttcagtgccacacgcacaaatcttgaagcacgtgcagccagaattgaaaaaggaaggcgttaacttgaagatcaaagtctttcaagattacgtcttacctaataaggcattggcttcgaaagaattagatgccaactacttccaacacatcccattcttggataactggaataaggaaaataatgggagcctcgtatcagcggggaaggttcacttggaaccaatcggtgtttattccaagaaagttaagagtctaaaagacttgaaagacggcgcaaccgttctggtcagcagcaacgtggctgactatggtcgggtcctgacgttatttaaggatgcgggtttaattactttgaaaaaagggacagatttaacttcagcaacttttaatgacattaagaccaacaaacgtcatttgaagtttaaacattcatacgaagctaagttaatgccaacattctacaaaaataacgagggtgacgcggtcgttattaacgcgaactacgcggttcaagctgggttgaatcctaagaaggatgcgattgcacttgaaaaatcagattcaccatatgccaacattgtggctgttcgtaagggtgataagaacaagccagctattaagaaactaatgaaagttttacgttctaagagcacccagaaatggattgaaaagaagtacaagggtgccatcctgccagtttcggccgactaaacggaccatcttaaatcagaatattgattgattgagctagcttcagggattccctgaggctagcttttttcacggagtttgactacggtaactttccgaagcgggttaatgaaaatgcacgtttgatattatctaagtagtactattgattaaattcttatgagacagcgtcctgcttgactttatagcggttgcaaggtacgctaaccaagttaaataaactacagattggggtttgcagcatgcgtaaatatggtgtgatcgggttaggccaagtcggtgcgacagtggcttatacgttggttcaacaaggaaccgttgatgaattagttttaatcgataagaatgaggccttggccaaggcgcaaaaactcgatttagacgacgcgtcacctcgtctaagctcaaccactaagattattttaaacgattattcagctttggccgatgccgaagtgttgatcgtggcttctggcaatattggtgccattgatatgaatagttccaagggtcgctttggtgagtatgatttaaaccaagcgattgtacgggagattgcgcccaagattgtggcatctggcttcaagggtattttgatcgatattatgaatccgtgtgacgtcatgacggattatttacaacgaatgacaggttttccacggcaacgggtttttggtacggggaccttcttagatacggcgcggatgcaaaagtatgtcggacaagcagctggtacgaatggtaaaaatgttgcggggtacgtatatggcgaacacggcaactcacaatttgtagcttggtcaacggttagcgtcaatgggcagcctatcaaaaatttcccaggtctgaaccttgatcaacttgaagaagatgcaaggcaaggggcatttgcagtcatggcgggtaagcattatacaaactttgcgattgctacttgtggtgtccgattggcagaagctgtcagcgcggatgcacaactggcttgcccagtttcagcttttgatccgcaatatgggacatacgttggcatgcctgctgtgattggtaaaaacgggattgaatcattaattcaactagatctgaccactgatgaacgagcgtcgttagcagcgtcagcgaagtttatcaagtcgcaagtggacgttttaccgcaagcataagctttttctaagcatggattgaaacatcttgtcattaaacgtggcctaatcagggtgtgcggtgtggacttgggtattggctcaggttggcttcgtgacgtctataattaggtcacgttttatgattgaatggttcttttgggcagacaggcgctgacatgctaaaatagaaggtaaattcgagattacgaggtcattatgcaagcagagaaattgatgcaggttaaggatgcagtgttaaagttaagacaacaacttcgatcgggacaaatctatcagtcactgcccagtcgaatggcaacgctgattaagcagttaccgagtaccgtgacgaccacggtaacgattccgagcgacgaagaggtgcttccactgattgcaacacttcatgagcagttgaagaaaggcacgttgaccgcgatgagcgacgatcaaatcaaattattgatggcacacgttggttcgctgaatccgctggttcgtgatcaaggcgtctactatttgttaaacgaggcattacagcagcaggtactcacaccggaacagttgggcgatatttttgatcagttgattcaagatcagatgttatttgcacacatcgatgagccgcaaaatgatgccatttatcagcggtcatttgcgatactattactgtcagtgctcttgtatgcggaccatgcgggtctcaagtttatgacacccgcgcggctggatctagttgttgagcaaatgacagtctacattttactcgaaaaggatactcgggggtttgtgggcaccaccggttgggcgcatgcgtacacgcatattggcaatatcttagatgaactggcagatgagtctcaactcgcacgtgcggataaattattactgttggccgcattgattgctcgttatcaaaagttaacaacgccgttgatttttggcgagccagaacgactatcgacttatttgaccttgattacaaacaaacatgagctttattgtgattatttgttaactgcgatgaaggactggcatcagcagttgatgatgcatactcgtccggctagtgaagctgaatggacgcagattttcaatcgtaatcgattattggaagcacttgcattacacgatgatctgccaacggccgtcgtagattatttggatgatgaattagaatttttaggttagttttggaaggaagtcttttgaatgcaggcaaaagcagttggattaacgcaagggttgccagtgagcgatccgaatagtttacaagatgtcaccattaatgtaaatcaacctcgtggccgtgatatcttagtagccgtcttagcaaccgcagtcaatccaatcgatacgaagcagcggcaaggtcaatcgccagtgacaacgccgcgaatactaggttttgatgccgttgctaaagtgttggcggtcggtgaagcagtgacaacgattatgacagatgatgtcgtttattatgctggcgccgtcgatcggccggggagtgatgctcagtatcaattggttgatgaacggttagttgcgtgtgccccgaaaacgtggtcgccggcgcagtcagctggtctgccgctaacgacactgacagcttgggaagcattgtttgaaaaattaccattcactgcagcggctgacgcgaatcttggtcagagcgtccttatcatcaatggtgctggtggggttggctcgatggccatccagttggcaaagtgggcgggtcttcaagttattacgacgactggtaagccagaaaccactgaatgggttaagcggttaggtgctgatatcgtcttagattaccatcaggatctgggatcgcaattagctgcggccggtttgcaggctgtcgatcatgcgatactattacactctacggatcaatacttgccattagtgacaccgctagtccggccacttggcacaatcgtcgccgtagtgacaaatcagcaccccttgccaatggcgttactaaagccgaaaagtttgaattttgcttgggagtttatgtttacgaaggctaactatcagttgccatcgatggcgacgcaggggagtattctggcacaggtagcgcaactggccgatgccggggtgattgtaccgacgaccaagcggactttagctggaattaatgcagcaaatttgcgaactgcgcacacaatcgtagagacggggcaaatgttgggtaagattgtcttgactgcgccatttgacgcgtaaaaaacaacgttttattgtaaaaatgttttcaattgtgctcagatattgtagaattaactaagccgtagtatgaaataaaccttgataggatgaacaaaattatggagacacaaaaaaagatccatgttggtatgttgtttggtggtaactcttcagaacatgatgtttcgaagcgttcagcgcacaacatttatgatgccatggacaagaataagtacgagattgacttgtttttaatcacgaagaacgggattgtcttgagtgatgctgcaactcggcgcgtatttgatggtgaaccagaagatcaagtcgtcgccgaagaaatgccaaagttggacatgagtgatccattagctcccatcaagaacctgacactggccaaagatattgatatcttctatccagtggttcatggtaacttaggggaagatggtactttacaagggctgttcaagttattgaaaaagccgtatgttggtagtggtgtcttagcgtcggcagctagttttgataaggatattacgaagcagattttaacgcatcatcatattcaaaacaccaagtacgtggtggttacaccggaaaaccgggaccaaatgacgtacgcttatttacaagcccacgtgggtgatcatttattcattaagccagccaatcaaggatcgtcgattgggattcataaagctgagaatgaacaagaatacttggatggtttggccgatgcgttcaaatatgactacaagattttagttgaagaatcgattgacaatccgcgtgaagtggaatgctcgatcttaggcaatgaaaatcctaaggcatctaagcttggtgccattgatgtgccgaagacggacacgttctacgactataataataagttcgtggatgcaagtggtgtgacgttcgaattaccagtcgaattaccagctgatttgacgaaacggattcaacagatgtcgctagacgcgtttaaagcgcttggtctaaaaggaatggcacgcgtcgatttcttagtgtctgaagatggtgaaccatacttgggtgaaatcaatacgttacctggttttactaacattagtttatatccaaagctatgggaagtttcgggcattagttatacggcgttgatcgatcaattgatccaacttggttttgatgaattcaaacgtcaatctgatattcactatgatttcgttgcgttagacgcggaataagatagtaatgagttttgtggtggttgggatgaagcgattcatcacggccgcctttttttgtgaggaggggtcaggttgttaagtcgcggatggcacttagtgatgcagggagcgcgccaactggctggaccgctagcctgctggtggttggccggcatattgctggcggtactcgctaaggtgctcgggattctggtcggtggggtagtcagcttgctaggcttgttgcttttgagtgcctggttaccagccatggtcgctcgtagtaatcatgagtcgtggcaggccggtcaatttttgtatcgctgggtgctgttaatgtttacggcggtgtggtggttaccactcggttggttaggctatttagcaactttacaagcgagcatacaattgccagcgactgttcaaaatataatctttaatacgcgttatgactggcttcctgtggcgggaccactttggctgttgggctggctgattagctggaagtggttaccagcactccaacgccaattgaccgctccgaccagctggcgtaattattggcgaacgggttggcggatttcctggtggacagtctttaaaaaaagtcgaaatgtgtggctgttcctgattagctggctcgttatggcaatcattagtggtggcatagtgtgggctagtggcgctgttagccagctggtcagtcaatttattgcagttttcatgatgactgggttgcaactgctggcttggttaatgtttatgggatggtggtcgtgcctttggccagaaacagcaatcgccggtcactctaactggcaaactgggctacttacgttgaccggtttgctagtcttgggtggttacgcaggctggtggctaggaacgccaccaacggcgccgctagcaattattgcacatcggggtgttaatggtcgtgacggtgtccaaaataccacagcggcgcttaaaaggactgtaaagcaagttcagcctgatatggtcgaaatggatatccagccgacagcggatcgccactgggtcgtcatgcatgatccaacgctgaaagctttagcgggtcaacccggtcccgttcatgagtaccccgttgataagttgagtggattaccactacgggagcatggtcaaaaaggctacttgagtacgtttaagcagtactttgcggtggcacacaaattacagcaacctttattagtcgaaatcaagtcagttgggacggctgatcaactaatggggatttttgccgacaactatgcacaacgactgatacaacaaaaaggggcggtacactctttggactatcgtgtgattgaacgattacatcaacgggcggcgcaactaccggttggcttcataacgccgttttatctgacggatttttctaattccgtcgcgggattttattctttacaagcactgaccgcgacccgtgagcagatcagtgcggcccaccgccaacatcggatcgtctacttctggactgttgatcggccgcttgcaatgcagcgactgacggccatgggggctgacgggctgatcacaaatcgaccgggccaactacgaagattacagggtcaatctaagcattattatttttatcaattgataaattggttagttagttggttataaactactgaaagaagtatgagaactaatcttaattattaagccacgtcaaccgattaattgagggtgtcatgacaattgatgtttgctgttaataaggttaatttgctcccctttaaatcgctttcagtagttctcacttttaatgaacaagtccttgattagggtggttaacgaactgtaagcctggataattaataaatgaccttcggccgatatcatggtataaacttaatattaaataagaattacgcgtatttcttgctaaaattccgttatgtgaatataattatatgcgtaattggtattgtccaattggttagtgctcaattattcgaacggattaacgaggattgattaggtgtcacgatacccttgttcatttagtgggggcagcaaggggagttacaaaatgagtttggtttaaggcaatcaatgaagaggggttaagcatgagaatattaggagaaaaagtgcggcagttcagaaagcggaagggcatgtcgcagaaggaactggctgatgggatttgtactcaggcaacgattagtctaatcgagaaaaaaagtaaaattccaagtatgaagattatgatgaaaatttgtaatcgattaggaattcgtttatcggaagtcattattgaaaatgacgaccagttatatcggaccttcaaaaaaattgatactttgattcgacatacacaactggaagaggctcaggatgtgttccagcatatccgtccgaagcagttacgtagtaatacggataagaaacagtattattactatgagggctatcttcaattagtgctcaatgacaatgctgacgaagccatctttaactttgggatgttgcttaatcagttcgtcaagtctagtcacgatatgtttgccatcctggccacacttggaaccggcttagcttatgaacgtaagcaggcctatgacaaggctgaaatttttgtcaaacaggcagttgctaccttacacacaatggatgcgcaagcaatgccgatgggtgacgacgattacttacaaaatgaaattttgatttacgcctcagccgcacaattgtatgctaagatcaattttccagaggaagctttggagttgatcgacttggcactcaagaaggctcaggagagtcagtcactttatttattagaccgtttgtatgcacaaaaggcggccaatgaagttgttttaaataatgtccagtcagcgcatgatcactattacgtggcgtatgcgttaagtctggtgacacataacagtagtttgaccgaaaaaatcacgaaagaaatggccgagtaccatattgcacccttgcaagtggctaacgacgcttagataacgtgataggacagttagcggtgaacggccgcgcttaatgggagatattgcggttcccattaggcacggcacaccgctgactgtcctatttttaataccggggggaatgtgaagatgagttgtcaaaactgtggttaccaaaattcaccgcatgccgtgacttgcctaaaatgtggtcatcgtctaacgccagtgaatggtgatgtcaatcagcaaagccgagtccagcggcggcgtcaacaatcacggcggacaactttttcgagtcgctttaggccacaaacactccttggggtattaattgcggggttactattgctgggtggcggctatatcgtgggacaactattgtggtcgtctacgacatcggcaactgccgagtcggcaggtaaaagccaggtgcataagccggctgccagcgattctgacgcactgatgaaggcaacacagacatttccgactacgacagttactgatctggttgcgcaagcaacgaatgggttggctggtcaaacttcggtagcggtgatgccattaacgggtagccagaccgtggttttgaataatcgagcgcaacgtgctggcagtttgatcacgttatttattatggtcactgcctttgatcaggtccatcaaaataattggcgcatgcaggatcgttataccctgcgtgctgccgataaagttggtggaaccgggacgttgcacacgttaccagctggaagccagttgacgtatgctgaaatcacgaaacgcatgattacggagagtgataatacggctgctaatatcatgttggatcgtgttggcggcttctcggcggtcaacacggaaattgcacagttgggtctgactgatacaaaaatggctcggcggttaatggatactgccgcactaaaggccgggcatgataacgatacttcggttcgggatgtggcaacggtgctgaaacgactggcgaacctgcgtttgatctcgaacaaagccgatcacgcgatgttaacgattttgaaggcgaacacggatcacagtaagttggtcaaaaatctgccaacacgcgcgacaatctataacaaaactggggactatcaagcatacggtgttcaaaatgatgcggccatcgttcagaatcgtcagggaacttttatcatgacgatgatgactgctagtggggaacgtaccgcgcaaacggtcgcgatgaatgatcttggtcaggcgctttaccgggcaattttagagcagtaagcggtatgattttggcaaatagtaaaaaatcggccagtgaggtaagtaacttcactgagccgatttttattgtacgtgtatcaaaagattactttttctttggtttaggagctggcttattttccaagtcagtccggacaacgagaacgtcacaaacagccatccgagtgacatattcggtgactgacccgatcaataagcgttcaaccgcgttgagaccagttgcgccaatcataattaaatcgatgcccatatccttaggaacgtcgcgcgcaataatcgtcttaggtgcgccatattcaatcgaataatccacgttatctaagccgtccgccttagcttctgcaacgtacttgtccaacgttttttgagcagtatcggtcacttgttcaaccatggtcgtatcaaaactagaaatgttttggaaagcacgggtatcaaccacgtggaccatgtgaactgaggcgttaggtccgttccgtttcgcgacggcaaccgcctttttaaatgctaattccgcttcataagaaccatcaacaggaactaaaatgtgttggtattgttgtaacatcattctcacccctcattactttataactatattgtaaaggttttcgcaaaaaataaaaagcgttttctatgagatttgcatgaaactcactaaaattagtgcaattgccatcataatcagtgaaccgctagccagtacaatggcaattagcattgtcgcttgaacaaagatggtcacgaaacaggcgatggtaactagtaacattaagccgccaccatagcgtgcgacgtgtttgattgtcggcgctttgttcgggtcaaaaaagagaaatggtcgggactggtgcgtcagcagataataactgagccaacccgcaatgagcgtgtatatgacaagcagtaatgtaatcaaaatgaacctccaacaggtgatgttaatcttattttagttgattccggaagagaagacaaatgcaatgctagctaaagataagcgattagtactagtagttcacacaacacaatttagcgtcaaatgattgcgacacacgtcatgctggttttatgaggatgagtaattgttcaggagtgtcggattgttgcagaaatacccaaaccagcgtgatggactgtatttcaatagccgagattattcatgtataaccggcttcccaattaaccattctccccatgagttttggacggtgttagtaaaatgacgttgtgaatttgggtcgctttcacgccacaaaaaaaggccaggaacaagtcctgaccaacggaagtaaacttccggaaaaactagtggtgccgttaatcgcccttcagtattgacccgctttaaggcaggtgggacgttctgactaattcgctaactaccaaaggataaggcatgttatggaattagctaacggacatcccaaagtagtattaattgttcggcaacactttgtttagagcaatgcgcacaccttagtaatttcgactcttagtctagcatataaaaataaaagttgcaattattagcacaaccaaggtattgttagcgatttctctcgttagcctttaataatttttcgtattgttgcgcaagggctgtttcgtagcggccatttgttttgggctcgtaatacttggctgatttgatggcatctggtaaatactgttgagcgacccaatcacccgggtgatcgtgtggaaaatcgtatccaacaccatgaccgagtttggcagcgccttgataatgcgcatccttgatgtcggccgggatatcaccgaaatggccgtcacggaccgttgtgagcgcggcatcaatggcactgatccctgaatttgactttggcgataaggctaattcaatcacagcgtcagctagcggaatccgtgcttcaggaaatcccaattgatcggcagcttgaacagctgcgacggtgtgggcacacgcggctggattagctaatccaatatcctcataggcaatcaccatcagccgacgcataatactctttaaatcccccgcctcaactagctgggctaagtagtgtaatgcagcgtttacgtcggaaccgcgtatggacttttgaaaggccgagatcacgtcgtagtgggcgtcaccatctttatctgcggataaggctttcttttgcaagcattcttcaatcgtttgttgtgaaatggcgatggtgccgtcatcggccggagacgatgataatacggccaattctaacccattgagggcactgcgcaaatcaccgttggtagcggtgcacaggtggtgcatggccgcgggtgctaaatcaacgtggtaactgccaagaccgtttttttcgtcagcgagggctcgttccaccgcgtgctgaatatcatcgtcagtgagcgggaaaacttgaaagatctgcgttcgactacggatggctggattaatgctaatatatggattttcggtcgtagcaccaatcaaaatgatgcggccactttctaagtgaggcaataaaaagtcttgtttagttttatccaaccggtggatttcatccagcagaagaatgaccgtcccgctcattttggcttcttcggctacgatttgaagttgttttttactgtcggtagctgcattcagcatgcgaaaagcatacttggtggaaccggcaatggcactcgcgatactagtcttgccagtacctggtgggccgtatagaatcattgatgatagtcgtttggctttgaccatccgggcgatgatcttgcctgggccgaccaattgttgctggccgacaacgtctttcagcgtttttggtcgcatccggtaggctaatggttgttgcatcgtttgaaatccctccttgcaaaactagtcccaactattatagcatttacaatgaaggacaccgaataatcagtttaacgaacaaaataattataaaggattgatcattatggaattagatgccgttggtaaggcaattgtacagtatcacttagtcccactcgttcatcaggctaatttaggactagaggtcaccatgcaccgggtggacgaccatggtcacttagcgacgacagcacacccgcaagcgtttggatcagcgcaacaaaatcatcagttacgtccgggcttttccgcaagtgctttaaagtttactacgccggtgcgtcgtgacattcctgcattgatggcgtatctgaagggcttgaataccgcagcacggcggtcactcgatgcggacgaacgactttggccactgtcgagtacgcctgtgttgccggatgatctaacgaacgtgccactggctgatgttgatcaagtcagctatcagcgtcgtcgcgacttagctcgtaagtatgagttacagcgattaatgacgactggtagtcacgtgaatatgagcttgaatgaagctttattcacccgtttatatactgagactttccatcagcagtatcacagttatgttgactttcgcaatgcaatttatctgaaagtcgctcagggattggtgcgcatgaactggctgattcagtatttatttggcgcttcaccacgcctagccgttacggatactacgagtcgtccacagcgcagtagtgttcaacatcccgatggtcgctacagtcaagtgacgggagactatacgtcaattgatcgctacgtggccaagttgacggcggctgttcgtcaacagcagttgttgtcggtcaatgattttgacgggccagttcggcttcggagtaatgggcagctagctatgatggcccggcagggggtctattatcttgaataccggggcttggatctcgatccaactagtccagtcggggtggacgcgaacgcggtggcatttgttcgtttgttggcgagttatttcgtaatgatgccggcacttccagctaagatggtatcccaagtcaacgctcaagctgaccaattgacccgtcaagttttgggtgaaaatccaacgacggctagtgctcaggccgtgccggctgttcaagttttagatgcacttgctgattttgttaaaacctatggcctaccaaatgaagatgccgtgttactcaaacagttgaagtcgcgggtcactgatccaaagaagacgctgagtgcgcagattgccatgcaagccgatccgttagcatgggcactcgaacgggctgcacgctatcaggaatcgagcaatgaacgtccgtttgaacttgcgggctttaccgcgctagatctatcgagccagcaactagcccagcaggccttgacgcggggagtgcaggtggacgttgttgacccacacgctaacattttacgattgactaagttaggacggtcgcaattagttgtgaatgggagcggaacggatttaaatccacaggcgctaacgaccgtactgacacataaagcagcggccaaacaaattctggctgagcacggggttccggtgccggcttcacagacatatcatacagctaatcagttgattgctgattatgatcgatacgttcaagctggtgggatcgtattaaaagcggcggatgagtcgcacaaagtaattgtctttcggattatgcccgaacgcggactgtttgaacaagtcgtccggcaactattcgagcaaacgtccgcggtaatggccgaggaagtggtagtcgcatcaagttatcgctttttggttatcgatggtcgtgtgcaagcaatcgtcgaacgaattccagccaatattgttggtgatggtcgctcaacggtcaagacgttacttgatcgcaaaaatggtcgagcgttgcgcgggaccgcttttaagtggcctcaatcagcgctacagttaggaacgatcgaacggtatcgcctggactcatatcacttgaccttagattctgtggtcagccggggaactcagatcttattacgagaggatgcgacttttggtaacggggcggacgtgctagacgcgacggctgatatgcatcaatcctatgtgcaggcggtggaaaagttggtagcagacttacacttagcggtcgctggggtcgacgtgatgattcccaatctctatgccgaattagtgccagagcatcctgaaatggcggtatacttgggtattcatgcggcgccgtacttgtatccgcacttgttcccaatgtttggtactgcccaaccagtggcggggcagttgttggatgcattgtttaaaaatgaagattaagttgcgattgatttaagctgtaatcatacggaattataccgaaaaaatgagcttgacaaggtaatcttgttaagctcattttttatccctggaaaacgcatttggacattcttagataaaatttacgtttaaataaatacaacagaaaatatgaaaacgataccaaaaaatgttgacaatcaaaatataagcttgtattatgatgaatgaagaaagtagttctattaaggagggcgtaaatggcaacgatttcagacgtcgcaaagttagcgggtttgtcagtctcaacagtttcacgggttatcaataacagtccacacgtatcaagtaaaaagagaaatcttgttaaagcagcaatgaccgaattgggttacgttccacggccggccgctcggcaactgcgcgggtctaaaacgaatacaattgcggttacaattccacgaatcgtgaatccgttctttgcatatttggtagatgctattgaacgggttttagatgagcaaggttatagtacgctgattgttcagacttttggtcgaccagaagaagaggtgacagcattaaatttattgaaaaatcaacaagttgatggtgtgattctttgctcaattgaaaactcatgggcagttattggagcatatcaaaaatatggaaagattgtcctagttaatgagtatctaaaagaaaaagatgtccccgttattcgttcgaatcaatataagggtttttatatggcaaccagttttttatatgatcaagggtatcgtaaaattgcctatgctactggccgtaagaatatcgtgattacagaacgtggagaggattttgattcggaccggtttgcaggttttcaagattcattaaatgagcatcaattacgtttcaatcggcagtggttattcactggcgctcatacttttgaagatggtcgtaaaatattacaacaaatattgacactgaatgtacgacccgatgtgttgattgcggggagcgatgaagttgccatgggtgttgttcaagaggcagaacgatgcaaaattaatgttcctagtgccattggagtattgggcgtggacgaccagccaatgtctgcgaatctaaaaatcccgttatcaactgtacaacaaccggttaaaagaatgggacaagcagctgccgaagtcatgttaaaacagatcagtggcacagaaacgtctactgaaacagtatttgagctaaaggttattaagagagcatcagcctaatgctctttttaaaataaataatttggtatcgataccaaaaatggaggaattaattatgtcagtaattttagcacgggtagaccaacgtttgattcatggattaattgttaatcaatgggcacaagcattacaagttaaacggtttatggtggttgatgatgaattaagtactaacgaggccattaaagcaagtatgcggatgtctaagccagccggaactgggatgtctattatcaatacggaaaaagctattactaacttcaacgctggtaagtatgataatcaacgggtatttgttttagtaaaagaacccgctacattgattaagcttattgaaggtggcgtcgaaattcctaaagttgatcttggtattctatttaatgaaagcggtcgcaaaccagttacgaagtttgttgccttagatgatgaggaacgtcgtgatttgcaaatattggaacagaaaaatgtccctttggtaatccagtacgtgccaactgatccagaagaaccttttaaagcgtagacgaggaggaactaataatgtcaggtattcaaatattacaagatattcttattgttttgttagcagggtatatgacgattgatcagaacggtcttgtgattatgtcttggttcccggtaattgtcggaacgattactggtttgattatgggagatttacccactgcgttaactattgctgggacatttcaattaatgatgttaggtgtcgccgctttaggtggtgcgtctgcgcctaattacggattggcaacaattgtcggtatttttattgctgtacgaactggatctgggattaagtcagcgattgctgttgggttaccagttggattattagcaatccagttagaagtcattgcacggatcatcgtcaatttcttagcgcataagatgttaggtgatgttcaaaagcatgattttcagaaaatgcgtcgtgaagcctggtggggtccggccttgttcagtttgcaaactgccttacctgcaattctaattgttttctggggcgccgatgttgtcaaatttattttgaacgttgtgcctagttgggttacaaacggactaactgttgctggcggtatgttacctgtagtcggagttggcatgctattacggtatatgccagtcaaaaagttccttagttacattattgttggctttgtgctagcggcatatttgaagattgatgtcttgggtgttgccttaattggatttgctgcagcttattggtacttcttaagcgagtccaaaaaggtcagtcaagtagcaacaaatgccggtgtggttgaagatgaaggggacgattatgatgaataagcaaccaacaactaagattacgaaaaaagatcgtcggcgggccgcggtacgctataattttatggcttgcaatatctttaattatgaatcccaaatgggacctgcggtggcttgggcactggcaccagccttacgaaaaatttatgatgatgacgatgagtatcaagaagcattagaaaatcattttaattattataattcgacaactgtaatgtcttcgctgattttgggcgcttcattagccatggaagagcgtgatggtattaaggctaagacagcagttcaatcattgaagacaagtttaatgggaccgatggctggtgttggtgatacgcttgtctgggtattgtggccgacaattatgggatcgatttcagggtatatggccttacaaggaaacccattaggtgcaatcgtttggttgattgcaaacattgttttttggtttgtgaaacttaaaatgtttgatattggctttaccagtggtacgaagcttattacgtcattgggtgaacgactaaatatttttacagaatctgcctcaattgtcggactaagtgttgttggcgctctggttgcaacggtggttaaaatttcaatgcctgttaaatttgcggtaggtaaagtaacgcttaatcttcaaaccggaatttttgataaaatcatgcctgcattgttgccggcattactgactttattaatttatcatttgttaggcaataagaaatggacaccaacaaaaataatcttactagttattgcaatatcactggtaggaacatttttaggcatctttaaggcataggggagagttgtgaattatgaaacgtaaaattattttagcatcacatcatcaatttgctagtgggctggctgacaccgttaattttatttctaataatgcagctgatattgttgctttaacggcatacatggataaccagccagtagaacaacaagttaaatcattaatggctagtattcctgcagaagtggagatcgttattttgacagatatgctggcgggcagtgtaaatcagcaattttttaattatcgaatgcgcccccacacacaaattattagtggcatgaatcttccgttagcgttggcaattgcactagaaccgactgatcacgagttaacagatcagcgggtttgcgatttaatcacccaggctcaagaatcaattgtctcagttaatcaaatgagtatagaaatggatgatgatgatgaataaaacagagtggtggcggaagagtgttgtttatcaaatctatccgaaaagctttaatgacagtaatggcgatggaattggcgatataagaggtatcattgaaaagttagattatttgaagcaacttggtgtggacgttatttggctgaatcctatctatcaatctccacaagttgataatggttatgatattagcaattaccgagaaattgaccatcagttcgggacgttagcggacttcactgcattactagatgcagtacatcagcgacatatgcgattaattttggatttagtcgtcaatcacacatcaagtgaacatccgtggttcaaggcggctaagcaaagtacaagcaatcaatatcatgattattacatttggaaagatgggagtaaagaacagttgcctaacaactggggttcctcatttggcggctcagcttgggaatatgttgatcaactcggtcaatactatttacatttgtttgcaaagcaacagcctgatttaaattgggaaaaccttaaagtacgtcaggatgtatatgaaattatgcgtttttggttgaacaaaggcgttgatggttttcggatggatgtcatcagtctgttgtcgaaaaaaccaacttatccggatggtccggtcattcaaaataaagcgtatggcagttattattatggtgcagccaatgggcctaaaatccatgattatttacgtgagatgaatcagcaagtattaagtcattatgacattatgactgttggcgagacaccccatactagtgttgctgaggctgaaaaatatacggatgaacgacgtaaagaattaaacatggttttccactttgaccatatgcatttagattatgatgaaaatggtaagttttctacgagacgcttcaaattatccgcactaaaacaagtgtttaataagtggcaattaggcatggctgaacatcatggctggaatagcttgtattggagcaatcatgatcaagcacgcccggtaactcggtttggtgtcgatgatactgagtaccgagttaaatctgcgaagctgttggcgactgtgttacattttcaacaaggaacaccgtttatttatcaaggtgaagaactaggaatgacaaatgccaagttcacctcaattgatgactatcaagatattgaaacacataatatctatcaagactttattaatcataaacatctcagcaaagagtacacaatgaaggccatttatttgaagtcacgggataatgcgcggaccccgatgcagtggaccagcaaacataatgccggttttacaacgggaacgccatggcttagcgtcaatcctaactatactagaattaatgtggaacaagcgttaaaggataaagactcaattttctattattatcagcaactgatcaagttgcgtcattctttatcgattgtgacaatgggtgactttgagttgcttgatcccgacaatgaacaagtattttcatacttaagacgagatcagaagcagatactattagtcgccgggaattttaccgaaaaaccaaaaaaaattgttttgccaacagaactgcagaatagaccatgtgagaagatcattagtaatgatcaaaacattgcagaagagactaacagtgttgttttaccagcatatggtgctgttgcttatttgttcagtattgattaaatttaacagaggctaacagtgcaacaatcgagttgtccagtgttagccttttattttatataaaggattatagtcaatacacggtgtcgtgattgaaaacacctatttcgaattttatctaaatatctcttgttgaattcctggttgcctgttatactctatttagatatatatctaaatagttgattggaggtagcccgtatggcgttgaatacgacctttaaagcaattgcagatcctgtcagacgccagattttggaagatttacgccagaatcggcaatcggctggtgagattgcggctcatttcaagttaagcaatgcaacggtgtcttatcatctcaagcttttgaagcaagctggtttagttaccgtgaccaaggaaaaaaattatgtgtactatgagctaaatgcgagcgtatttgaggaaatgttgacgtggctatatcgttttagtccaaagcagggggatgaaaagtgatgacaaaaaggaacttgcagttgtggctgagctatattgttattctgttaccaatgagctacggcgtcgtgaattatgcggccttgcccgccaaaatggctattcattttaatttggataatcaacctaatggaatggccacaaaattattagtggtcgttggctttccaattatgatgatggcgtttcagctgatttgcgttggggtgacacggttgaatgccaatcataaggcaccggcgccacggtttgaacagatgatcatttggatcgtgcctgtactatcaagtgtgatctatgcgacaactatcagttataacttaggccatcaattggatatttggcgtattgccgttagtttgattgcctttattttcatggccatcgggaattatttgccaacaatcagtgcaaatcaatacgcgcagatgcaccgaggtggtcacacgattcggccaatgatttggcggcgtgttcgttattggttgggctatacgctagttggtggtgggatattgttactactgagtatcgtcacaacagcatgggtttcagtcagcctcatggggatcattgttgcggccttagttatcatgagtctttatggcactctagcgcgtaattaacgcagtcaaacgtaaaaaggtcctcatccgtgcgtggatggggacctttgttgtattaaagtaactttttgaatttatctagcaacccaggtgttttctcggcctggggtgttgctgatgaagtctgcgagggataacgctgcgcaacatcaataatatcttggttaatggcgcttgcagcagtgaagataagcgcgtaatcatcatcagcagtatggtagatgtcatccgttttgatagtgaatttgatattggcttgactagccgccttgatatacggcccaatcagttcctggtctaaattaccattaatatataattggtcatccggatggctcgtaaatgcttgatgaagtgagtcgacgtaattggcctgtttaatttgggcaacggtcactgcgacttcgacgcgttcccgaaaggtccccaggtacttgcgttgttcgtcgggatgcaactttggcgtcccgtgcatggccgtttcgatgcggtcaactggttgtttatctgtttcagccattgtctaacatcctttccttgatagtaattatcattgtagcatgttcctccaataatagcgaagggaaggggggtagcgttgcgttagtgaatgcggtatggttaatctaaattagttttggggatgataaaacttgtttacaaatcaagattttgaaatttttaatgaccagacgttagcgggccgcatgcatttaatcaaaacggtgatcgatcctaagttcgaacaggtcgcaccaacgattatagcgagtttacaaacacctagcgagccaccgttctacgcgcacgttgccaaacatttacggcgatttaagaatccgccggtagacacttgggtcgcttttagtcaaaacaaacggagctacaaagcctggccacattttgaattggggctatggcctgaccgtttgtttatctattttgatattttggatgagtgtaaaccggccgtgcaggcaaagatgcaactcgcagatttaacaccacttttgaaggccttgccggcgggctatgttatcagtaataatcatggggtgccggccacgcaacttgcaacaccggccaatattacgcaggccatcaagaaattcgatcagtataaacacagcgagttggtcgtgggccgcgcagtcttggtcggtgatccgttatttgaagatgctgatacgttgaataaattgatcatcacaacattcaaacaattattgtcgatttatcaaccggtcatggcggctgtgagtgctgagcgtcaggtctgaaattaacagaacatacaaaaaagccgccgcaaacgcgacggtttttaaataccggaaattaaagtttgttgtagtattcaacgattaatgattcgtcgatatctgcttcaagttcttcacgttctggtaaacgagttaatgagccttcaagcttatcagcatcgaattgaacgaagttagggcgtgcaacaacggcttcaacagcaccagtgataacagccaacttcttggacttttcacgaactgagacaacttggccgacactaacttcgtatgaagggatgtcaacacgcttgccatcaacagtgatgtgaccatggtttactaattgacgagcttggcgacgagttgttgctaagcctaaacggtaaaccatgttatccaaacgacgttcgagtaagatcatgaagttaacaccatgcttaccttcgcgaatcttaccagctttgatgaataagttagcgaattgacgttcagttaaaccgtacatcatccgtaacttttgcttttcacgtaattgtgtaccgtattcagaaagcttaccgcgacgaccttggccatgatcaccaggtgcgtaaggacgacgagctaattctttaccagtacctgaaagggacattcccaaacgacgggaaattttccaacttggacctgtataacgagacataaaatgtttcctccaataattttagttggagtaaaataatccgatgtaagttcgatattcgttcagattggactgcaggtttcaccattgcagccgcaggttactaactgaccaaaatattggcaccaatctgttgacgagcttacccactcactgctgcattattttacacaaagagtagcataacacgtttaatgctgattagtcaatgtgtgacgtcagaatcgccacaaattcggtcaattcagcttcgttatcagcattgaatcgatctaatgatggagagtcgacgtcgagtacgccgatttggtggccgtccttggtgattgggaccacgatctcagagttgctggcgctgtcacaagcgatgtggccggggaattgatggacatcggctacccgttggttcgtttgcgtttcaaaagcagttccgacgacaccagccccaactttgatgtgcatgcaagcgactttgccttggaagggacctaagtcgagctcgccagtttgttcgttaaataagtaaaagccggcccagttaaggttgtcataagtactgttgaggagggcactagcattagctaagttcgcgaccaggttagtttcttgaaacagtagggcgtcgagttgttggttcataagtgatgtttccgtggtagccatgtaaaaaatcctccttgaatgttaacaaattgttactgtccgttagttacgtctatgttataatttaagatagattttaattggattttcagaaaaaagcaaggttacggttctcaacagggtgaggcgcaacgcaattaaaacggaataaataatgtaaggggtattcgtatgcaagtagcaatcggcattgttgtggttgcgattgtcatctacgcggcggtcaaaggctttcaattttatatcgacaagcaagtccgtcaattgacggaacggcaacaggcgctagtcaagcaatcgcagaccacagatttcgaaaaaattgaacaactcggactaacgggcggatcgttagcgaagttggaagcgttgcagagcgctggtcaagaagttgataatgatcagttacccgccgttagtgagcaattaacggccattacttcgcaggcgcggggcatcagatttctcgatgctcagcagaatctgaagaaggttgcggccacattagatacgattgaacaacgacaggcagaaattcgtcagggcttgcaggccttagatgacgcggatgccgcgcaccgccaagcagtggctagtttagagaagaagtaccaaaacatacggaagacgttattatcgcaaaacttttcatttggtccgagcatcgacaaattggaggatcagttagctaacttagaaagtgattttgatcatttttccgaattagccaaggctggcgatcatgacgcggctgaaaaggttttggatcagttacatcacgatactggcactcttgaaatggatattgatcggattccaccgatttataaggacctagtgagtgggtttcctgatcagttagccgaactggctagtggttatcaacaattaacggctcaacattttcactttgaggtcgaatcgattgaaccagaaatcaaagcgttacagcaagcaatcgacgataatattgcgttacttggtgatttgaaagttacggatgctgaaaacggcaatcatgcgattgaaaagcggatcgaccacttatatgacgtgatgcaagcagagatcgatgctaaggccgttgttgatcaacaacaagaagaaatcagtaagttcttgacacatgccatgaatcagaatcaccgcttacaaattgagttggatcgattagcacaaagctatacgttgaataatggcgaagttgaacggacgcgtgaattgaacgaacaactgaagaatatcgaagctgtttatcaggcggacgtcacagctattactagtaagcaagctgtctttagtgagatcgcagctcattttgccgaacaagatgagcagttgaaaggcattgaagaagaacaagtggcaattaacaaaggtgtggcgagtttgaccgctgaagagtccaaagcccacgagacgttgcaacggttcgattttgaaatccacgcgatcaaacgccaggttgaaaatttgaacttgcctggactaccgaaagactatttggactatttcaaagtagttgccaaggaaatcgaacggcttgaccatgatattaataagcttgtgatcaatatggacgacatcacgaaacagttgattgttattcaggcggacatggcgaccttaaaggaaaagaccagtgatttaacggatgctgcggttatggcggaacagctcttacaatacgctaaccgttacaagacgaatcatgaagaggtgcaagaagccagcgtggaagcacaacggttgtttaccgagactcatgactacgcgcggagtttagaagtaattgcaacagctgtggataaagttgatccggggtcctataaacggattgaggacagttactatgcgaataaacaagctgataagatgaacgatgaggcctgacgaggatagttgggaccgcccatatgcaaaattttagttaactgaaaataaccagctggtggtgattgttaaatgacaaccgccaccagctggtttttagttggcatcatgatgcaagtaatcgtgatggttctgagaagggtgactgggaacggccaacaaaaatggtgtttaggacgcaattgtcgtgtgattaatcagaaatttgaaacaaaaacccttgtttcactagtaatatttggtataattgcaaagaattcttatcgaaagtaagtgcaatgcacactttcttggaaagagaaggcgtagtaatgatttattttgacaatagtgcgacgacgcaagctgctcctgccgtactggagacgtatacaacggtttcccaaaaaatttggggtaatccgtctagtttgcataactttggtgaaacggcctttcatttgttggaacaatcacgtcaacaaattgccggcttactaggtgtgcaagcccacgaaattttcttcacgtctggtgggacggaaggcgataattgggttttgaagggtacagcgattgaaaagcgggcctttgggaagcatctaattaccacggcggtggaacatcctgccattcataattcgatggaacaattgaaggaacttggttatgaagtgacttacttaccggtcgatcaggaaggccgcatcaacgtggcggacttgaaagcggcaattcggcctgacacgattttagtgtcaacgatggcagtcaataatgaaatcggtacgattcagcctttacttgaagtggcggaactactgaaacaatatccgaaaattcattttcatattgatgcagtccaaggaattggtaaaggaattcagaacatgatcatgaatgaccgggtggattttgtgaccttttcagggcacaagtttcatgcgactcgcggggttggctttatttacgcgcgcaatggtcgtaagttagcgccattaatgaatggcggcggtcaggaaagtaactggcgttctggaactgagaacttaccagcaattgccggcatggcgaaggccctgcgattgttgctcacggatgaagatggtaaggtagctcgtgagcgagctatcaaacagcgaatctacgagcacattaagtcgtttcctaaagtgacgatttttagtcagccaacgacggggttcgcaccccacatactgtgttttacgatcaacggtgtgcggggcgagaccattgttcacgcgtttgaagatcagggcatttatatctcaacaacgagtgcctgctcatcgaagaaacacttggcctccagtactttaatggcgatgcacgtgcaagaaaacattgcgacgagtgctgtgcgggtcagcctcgatgagaataatacgctggcagaagctgaccagtttattaaagtatttgatcaactttatcaaaaattctcaaaaattaatgcagacgcataacggaaaggaacttgttcatgcagtacactgaaatcatggtacgttatggtgaactatcgaccaagggcaaaaaccggcggaactttatcgatagcttaggccgtaacgtacgcaaagcgttgcacgactttccagaactaaaggtccacgcgaaccgtgaccggatgcacatcatgttaaatggtgaggatgccgataaagtcatgggccgtttgaagctagtttttggaattcaaaacttttcaccaagtattcgcgtcgatgccgacatggatgccgtctatgaaacggcgattgcgatggtcaaagcccagtttaaaccggggatgacttttaaaatttacacacggcgctccgatcatcagtttgaatacgatacaaatcaaatcaatgacatgctcggtgggcaaatcttggaccacgttgacgggattcaagttaagatgaagaatccggacattgtgttacgtgttgaagttcggttaaacggtatcttcttatcatcagaaacgattcagggtgccgggggattaccggtcggcaccgctggcaagggaatgctgatgctttctggtgggattgattcaccagttgccggctaccttggcatgaagcgtggtgtggacatggaaatggtccatttcttcagtccgccatacacgagtgaacaggcgttagcaaaggccaagcagttagcgtcaacgctagcaagttactctggtagcgtgaagtttattcagattccattcactgagattcaagaagaaatcaaagaaaaagtgcccgagggttatcttatgaccgttcaacggcgcctaatgatgcgtttgatggacgccattacgcgtcaacggcatggtaaggcgatttttaatggtgaatcattagggcaagtggcttcacaaacgatggatagcatgattgccatcaatgatgtgaccaccttgccggttttgcgcccagtgatttccatggacaagacggaaattattaagattgccgaagatattgatacctatgacttgtcgatcatgccatttgaagattgttgtacgatttttgcgccgccagcacccaagacgcatccgaagctagaccgttcacggtcctacgaagaacggattgatgttgaaggactgatggcacgcgctttggctggtgttaaaatgactgagatcaagccgggtgaaaattatttgaatacacaagaagacgtttttgctgaactattgtaggtcaaaaacgggtgatattattaccctaaaaacgagtacccggtaatactgggtactcgtttttttgatcctttggatgatcaagcgcggaagctcatttcgtaatggtaagtcagctaaataataggtcataatcagccaaccaaggtcgggactatgctacgataaatttagattgaatcagcgaggtgagtggatggagtggcaacaattattaatggaaaatacggcgttgatcaatgcacaggttgttcagattgggctggaacgggaaggccagcgggtaacggtgaccggtcatttggcggatacggcattatcaccaacacttatcagcgagttgtccggcctgcaacgggactttgcggagacacagttggagttagtcacccaaccgcaagcaagtgcggttgctgcgttgcacgccttaacgatgctcacacaacaagtccggcaaaggcttctgcctgaactgatttggccgctaagcatgccgcccacacttccacgagaagaccgggatattccaatcgctaagttggatgcggccgctgtcgcctatcgacaaggacttgctcaccgctatggccgacgacgtcaaatgttgtcaggtgttcactgtaatgtgagcttggcggctagtctgatgatgggattgtatcaggcccagacagatagtcgtgatttcaccacctttcaaaatcactgttacctgcacattgcgcagaattatttgcactatcgctggctactgacgtatctttatggctgctcaccatgctgctggccacagtctggtcttacgccaccagcccagcccgttcgaagcttacgcaacagttctagcgggtataccaatcggccgggtgttacggtctcgtacgcgtcgttaaatgattattgtcaaacactgcaagcggccgttgataatggaaaattaagtgcgaccaaggaattttacggtcaggttcggttgcgtcatgctggtggtcattcacaactatgtcaggatgggattcaatacttggaattacgtaacttagatctgaacccatgggccggtgcgggcatcgatctgtcccaactgacctgcttaacgtggttcgttttactgatgctctggttaccagtgccagctagtacggataattggattcaggcgggtcagcacgccaacgaacaagttgccatcgaaacccctatgcaagtgactcgacagctaactgaaggcgaacaactagctgacgcgctacaaactatggctaccagtttacatcaaccacacgcgttgcaagtcgcccaacatattttaactagtctgcacgacccggccaacacactcgctgcccgctgggaacaacaaacaaacgattcgctcgaacgtgcaacccaacttgcactccagctggcgacgacaccacattttaatgcttgaatatactgaaatcggcgtacacacatgttggcacgttaggacgcacatcggctgacgaacaacaaaccaactaataagcacgtttaaaccatgactaacgtcaaataacgcgtcgcatgtcaagaatgataatttttgagacgattatttgcgcggaaactgaaattgcgttaaatttgagctatactattactaccacaaatattagaaaaccattagttatcgaaggggtgttttacgtgcaagtattatttcatgatcaagcgttagacttagtcggtgaaccgttacaagatggtgaccagttaccgaagttcaaagtgttcactacccatgatgaaaagattaagactaaggacttgctaggtaagcctgtcttgttaagtgtgatgccagatattgatacgcgagtttgttctattcaaacaaagaagttcaatcaacaggctgataagtacccccacgttcaatttttagccatttccaataacgcggttgctgaccaagctggttggtgcgctaaggaaggcgttaagaacttaacggtggcttccgatgaagaactatcctttggttacgccaccaatctatacttgcccaacaatgggacgttgacccgggcgatttatgtcgctgatgcggccggtaaaatcgtttatcatgaaatcgtgccagatgttagtcacgagccaaattacgttgcggcactggatgccttaaaacaattcgaataaggattgacggcactcaggaaattcattacaatagtgacaaccagcaatgagcaagagagtagcggtaaacaacgtcaacagagagagcgtgaacagtgaaacacgcttggcggttttagcgtgaaggtagcttgcgagctgctattctgaactgttttagtaggaatagccggacgggatacaccgttcgttaacaacgatgtttaagctgtaaagcgatcacttgtgatggctttaaaattaggtggtaccgcgaagtccattcgtcctagtctaataggatgagtgggcttttttagtgccaaaagaaaggatgtgccccaatgtcagaagaaccaactactgatatgccaactaagtatgatccgaccgccgtggaagcgggtcgttatcagacttggttagaccaagatttatttaagccttcgggcgacaagaaagctaaaccctattcaatcgtgattccaccgccaaatgttacgggtaagctgcatttaggccacgcttgggataccacgttacaagatattattattcgtcagaaacgaatgcaaggttttgatactttatggttaccaggaatggatcatgccggcattgccacgcaggcaaaggttgaggccaaactgcgcgaacaagggatcagccgttacgatcttggtcgtgagaagtttgtccaacaagtttgggattggaaagacgaatacgcgtcgattatcaaacaacagtgggctaagatgggactgtcattggattattctcgtgaacggttcaccatggatgatggtctgtcagatgcggttaagaaagtcttcgttgatctttacaacaagggcttgatttatcgtggtgaatacatcatcaactgggatcctcaagcacggacggctttgtctgatatcgaagtgattcataaggatgacaagggtgcgttctaccacgtcaagtacccatttgctgacaaagactatactttcaatggtaagcattacattgaaattgccacgactcgtcctgaaaccatgatgggcgataccgccgttgcggttaatccgagtgatgaccgttacaaggaattggttggcaaaaaagtcatcttgccattagcagaacgtgaaattccaattatcgccgatgcgtacgttgaccctgagtttggaactggaatggtgaaaatcacgcctgctcatgacccgaatgactttaaggtcggcaaccggcatgatttgaaacggattaacaccatgaatgatgacgcttcaatgaacgccaatgcgggtaaatacgaaggtatggaccgttttgaagcacgtaaagcgatggtcaaggatcttgaagatcaagatttgatgattaaaatcgacccaattgtgcatagcgttgggcattctgaacggactggcgttcaggttgaagcgcggctctcaactcagtggtttgttaagatgaagccactagctgagcaagcgttgaagaatcaaaagactgataataaagtagaatttgtgcctgatcggtttgaagacacattcaatcaatggatggagaacgtccacgattgggttatctcacgccaactctggtggggacatcggattccagcttggtataacaagacgaccggcgaaacgtatgtcggtgttgatggaccaaaagatccagaaaactgggaacaggatccagacgtgttggacacttggttctcaagtgcactttggccattttcaacgatgggctggccaaacactgatgcggaagactttaagcgctacttcccaacggatacgctggttaccggctacgacattatcttcttctgggtatcacggatgatgttccagagtttggaatttactggcaaacggccattcaaacacgtgcttttacacggtttaattcgtgatgaacagggtcgcaaaatgagcaaatcactcggtaacgggatcgatccaatggatgtgattgaaaagtacggggccgatgcattacggtggttcttatctaacgggtcgacggctggccaagatgtgcggttcagctatacgaagatggatgctgcatggaactttattaacaagatttggaacgccagccgttacgttatcatgaacctgggcaccatggacaaaccggaattaccagctgcaagtgactggacgttagcagataagtggatcttgagtcgtttgaacgcgacggtcaaacaagtgacgactacctttgataagtttgactttggtgaagctggtcgagccttgtacaactttatctggaatgacttctgtgactggtatatcgaaatgagtaaggaagtcttgaccggtgatgacgctcaagccaaggccaatacccaaaacgtgttagcctatgtcttggatcaaatcttacggttattgcacccaatcatgccatttgtgaccgaaaagatttggttatcaatgccacacgttggtgaatccttagtagtcgctgcttatcctgttgaccatcctgaatttgatgacgaaacggcggaaagtgatatggcctcacttattgaattgattacggccgttcggagcattcgagcagaagctaatgcgaagatgtcatcagccgtggatctattaattaagacggacaacactcggttacaagctgttttcaaagctaatgaagattatattcaacggtttgcacatccgaagacactgtcaattggcgccgacgtggttgcaccgaagttagccatgacacaagtgattagtgatgcggaagtttacattccgttagctgaacttgttgacctcgatgaagaagtcaaaaaacttgaaaaagaacaagccaagtttgaaagcgaagtcgcacgggcgacgaagaagttaggtaacgaacgctttgttgccaatgcccctgaagacgtcgttaatagtgaaaaagagaagttagcggacaatcagacaaaactagctgccttaaagcaacgtttagttgatattaaggctgaagcttaatttgcgataatagttaactgaaatgtgtgttactggtaaaatggtaatcgtcccgttttgggatggttaccattttattattaaaacgtaaaatataagggctcattagctagaagtatggtgagcaaacggccaaatgatgattcgcgcggtttacaggaaggaagaccaacatgattgacacttattcagcagcattagcctttattcacggccggactcagttcaaaaaagccccgacactcagtcgtatgcgccaattcttacatgaattgggtgatccacagttaaaggtggccggcattcacgtggcggggaccaatggcaaggggtcgacggttgcgaatttacgcgaattatttatggcagatgggctaacggtgggaactttcacgtcgccgttcattgttcgcttcaatgaacggatcagtgttgacggcacccccatcagcgatgaagaacttgttggtctggtgcaacagattcaaccgatcgttgccaagcttgacgcgacattggcaagtgggggccccacagaatttgagatcattaccgcaatgatgtttctttactttgctgctcagccaatcgatattgccattattgaagttgggttgggtgggttatacgattctaccaatgtttggacaccagccgttagtgtgattactacgatcggttatgatcatatgcaaattctaggtaatacattgacggcgattgcgactcaaaaagcaggtatcattaagacgcaggtgccggtaattgttggtaaattaccggctgaagcacagcaagtgatgattgataccgccatgagcaaacgggcgccgttgcggacgttgggagttgattttacaaccaaattattaccgccccaaggctggcaagaacggtttaactttgacgggttagaggcgcattttaaagacttgacaactccgctactgggagactatcaagttgataatgcggccgttgcaatagcggcgtacctaacttaccaccaagcgactcagctacccgtggtcactagcgacgtcaaagcggctgtggcagcaacacaatggcctggccgtttcgaacgcttgaatcaggacccactgatcatgattgacggtgcgcacaatgagccggcagtaactgaattagcagctactttgagtgagcgatttggacagcaaaccgtttatgtcatctttgcggtcttagcggataagcagcatcaacaaatgattcagaccttgggcgcattacctaatgttcaattacggttgacacaattcgaaggtccgaacgcaaaacgtccagcgaccgacccgacgatgttggcacatgaaatgccaaatggccggaccgctgaagtatttgataattggcaagctgccttgatgcagacactccaagaaatgtcgagtgatgatacgttactactaacggggtcgctgtactttattagtgacgtacgggcttatttcaaggatggcagcgactcagaaactgattaggggctgacacggatgcttagaagacaattgcgcaagaaataatactgcgtccctggtactgatattatcaaagatgattgtgagttaactgaaaaaattgcgttaaaatgtcggtgaattaatggttagccggtcactttacgaaactactaggtagaaagggtggtttcaatgacgatgatcagcgaagaacaaataccgacagcacaagttcgtgaattaatgcaagcctactttgggacgtttttacccaacgacgcggtgactagcgcgatgcaggcctttgagcgtgagtacccgatagaggacgctatagagtggttacatgagtcgtctgaaaatccgcgctggcaaggtttaatcgtggcgctcagatgtgggcaactattaccccggccaagtcgattaattttggggcaggtatatggtagtgaacaactgggagccgttttagcacgggactttgccaacttagagcaggaacagttgcaattgttatgcttagatacgaaaaatcaagtgatcaaacgccaggtcgtctttcagggcacgctcaatagttgtccggctcaaccgcgggaaattattaaagttgccctaacgacaccgactgcccgggtcgttattgcacataatcatccgagtggtgatgtgacaccgtcaaaaaaagacgttgaatttaccaagcggttacaactggcttgtgaactgatggggttaccgctcttggatagctttattatcggtgtaaacgattactttagttttgccgagcagggcgtgttaaattgtaatacggattcgtaacagaatgtggtaaaataacggggttaggaccgataatttaatcggcctgatcgcgtttttttgttaaattttatctaagttaaatagtgggactgtatttttcattaatttacggtatgctaggactcaggcaatgcttttttaatgcagtgcgactatgctataatacttactattatgactaaataaaaaattaaatttgttaatgatgaagggatgaatgtagtgttcggatttgggacaaagaatatcgggatcgatctcggtacggccaacacaattgtgtacgttgacggcaagggcatcgtattacgtgaaccatccgtagttgcgaagaacacgaaaactggtgaaattgtatcagttggttcagaagcacgggatatgattgggagaaccccagcaagcattgtggcgattcggccaatgaaggatggcgttattgcggactacgatacgaccgttgcgatgatgaagtactttattcaaaagacactcggccgctcaaatggtaagccatacgtcatggtttgtgtaccaagtggggttaccgaagttgaaaagcgggccgttattgatgcaacacgggttgcaggtgcgcgggatgcatatgtcattgaagaaccatttgcagccgctattggtgcagggcttccagtcatggatccaactgggagcatggtcgttgatattggtggtgggactaccgatgttgcgacaatttccttaggtggaatcgtatcaagtcgttcaattcgaatggctggcgataagatcgatgactcaatcatttaccatgttcgccagaagtttaatcttttaattggtgaacgcacagccgaacaacttaaaatcgactgtggctcagcttctttggaagccgctgaagacttggaagggtcaacgattcgtggacgagatcttttgtcgggcttaccaaagacggttgaaatctcatctgtagatgtttcagaagccatccaagaagtggtctctgaaattatttcagccattaaagaaacccttgaagaaacttccccagaaattgcctctgacgtaattgaccacgggattgttttgaccggtggtggtgccttattgaagaatctttccgaagtgattgcggacgaaaccaaagtaccggttttcatcgctaacgaaccgcttgactgtgttgcagttgggaccggtgaatcactcaagagcatcgacgttatgaaaaagcgataacaggtgagcgggaagacgtcttcccgcttatttattgttaaatcattgaattttcgaccgggggttcattatgcaaaagtttttttctaaccgaaaactagtgattgcgattgtcgtgttcattattagtttcggcttgatgagtgtctcagtagccattcgtgataagaaatcgacaccaccattgatccaacaattcggaaacgatgtggctggtgcggttgaccgggtgattgcttggccagtcaatggcttacagagtgcgaccaactcagtttctgacttgttgaacacctatcaagaaaatcaaaaattgaagaagcaagttgaccaactggcgcaggccaaggttagtgcccagacgacgcgtgcggaaaacaagcagttacgcaagcagttgaaattaaataattcgttatctgattatacgacggtgaccgccaatgttttgacgcggacaccatcatcttggatgaaccaactcgtgatctctaagggtgcgacatccggtgtaaagaagaatatgcctgtcatgtcacaaaagggtttaattggccgggtcgtggaagttaaccaaacgaattctaaggttgaattaatttctaatacgagttcgtcttcgaataagtttgctattcagattacgaatagtgctggtaagactgttaacgggattatttcaggttatgataagagcaataatcttttagagatgggttccgtgacgtctaacgttaaaatcaaaaaaggcgataaagtcgtgacgagtggtttaggcggcaatacgccgaagggactttatgtcggcacggttgctagtgtcaagcaggatgattacgggctagcatccgaagtggaaatcacacccgcagcggaccttagtgacttaacagttgtgacggtcgctgaacaatagggaggtgcaacggtgcgttactcaagattaaaaatcatctttccaattgggttatttgttgcactctttttagacggctcggtgtcaaatgtttttgccggtaaactatttagttacccctacgccagtgtcttacacctagttttactgtggattgtcttcgctgtctttttagatgaccgtgataatctgtcggttggaatttggtctgcattcgtgggcttggtgtttgactggtactatactgggattttaggcgtttacatgattggcttaccgttggtagtctatatatgtcgacaaatcaagccatggatcgacctgaactttttaacgttactgatgatctatattattaatttgaccattttggaagcatttacgtatatttggtacacgatgagccatgtgatctctagtgggttagcagactttgcggtgtacacgctaggaccgacgattgcggtcaacctagccatctttgtcatattatattatccaatgcgtcggttatatctgagtgttaattagtcggcagaaaggaattctaacatgcaacagagtgtagttttaaaggccagtaatgacggctatgaactgattttacggcaagaagcaagtttcgatgatattatgatcgacttgaaggtcttgttggatcggttgcaggctgataatacgactgataaacaaatctcgtttgacctggatacggctagtcgactactgactgcggaacaaaatcaaaaagtgacacagttgattcaacgatatccgttattcagtattcataagctaacggcagatgttattttgacggcggatgctttagcgatgattgaacgtgatacggtgcatctggttaatcagattattcgcaacggtcaggtcgttgagattacgggggacgtgttgttcttcggtaagatccatgaaggtggggtgctccgggcgacgggtagtatctttgtgatgggtgaggtaaacggtgcgcttgaggccggttatcccgatcacaatgatgcggtgatcgttagccccttagcgaccgtcccgcgggttcgagtcggtgaattgttagaattagtggaccttgaaaaagttgttgatgggacgaacgtcgtctatattaatgacattcaagcgttggactaccagccgctccagcaattaaaacgggtacgaccgaagctatttactcgaaatggaggacgtgtttgatgggaaaagcaattgtcatcacctctggtaagggtggggtcggcaaaacgaccactacggccaatttagggacggcccttgctttgatgggcaagaaagtttgcttagttgatttagatattggattgcggaatttagacgttattttgggtctcgataaccggatcctttatgatattgtggatgtagttgccggtcgtgctcaaatacggcaggcgttggtcaaagacaagcggtttgatgacttattgtttttattgccagctgcacaaaatgcggacaaggatgcattgaatcctgaccaagttcgggcaatcgtagacgagttgaaaccagattttgattacgttttgctcgactgtcccgccggaattgaacaaggtttcatgaatgcgattgctggtgcggatgcggctattatcgtctcgacacccgagatttcagcaattcgtgatgcggatcgggtcgttggcttattggaacaatatccgttagccgaagcacctaagttagtgattaatcgaatccggacgcgcatgatgcaagatggtgagacgatggatattgatgaaattacgcatcacttatcgatcgacttgctaggaatcgttttcgatgacgatgccgtcattcggacttcaaataacggtgaaccgatcgttcttgatcctaagaatccagcctcacaaggctaccgcaacattgcccgccgaatcgaaggtgaaacggtgccattaatgaatttggatacacctaaaccgggtgtttggtcacgaatcgccggaatttttcatcgtggcaagtaaaaaaggcttgacggttgattaattttcgattagtatgaactcaacattaaaaaacagggaacagaagagtagttgtaaggaccttgccgagcgagttatcgatgatgggaagatgaccaaggattacaacgaaccacatctgtgagttggacagctgaagttagtaagctgtttcggttggcctcgttagcggcggagtttagtgataaactcgttgagattagttgtgtgagcaactagtgaatatgaggtggaaccgcgattaaatcgtcctcttaggcatgctggcctaaggacgatttttttattatcacaaaactccctgaggtaataactgtgaagttattacgaagtgaggtggcaccacggataaccgtcctcttgagtattcgactcaaggggacttttttgtgtacttgagtcgtgaccgattagtggacgcaggacaatgtgacctgtaaatttgggagggaaagtacatgcagtatattttagaaattttgccatcattattatccggtgccgttatgacactgaaaattttcatttggaccctgattgggtcgctaccattggggttagttgttggtctgggattaatgtctaacttcaagccgctgcaatggttattgcatttctacgtttggttaatgcgtggtaccccgttgttactgcaattaatctttgtcttttacggcttaccgttgattgggattgtttttccacggtactacgccgcgttattcgcatttattctgaactacgcggcctacttcgcggaaatcttccgtggtgggttacagtcgattgacaatggtcaatatgaaagtgcacgggtcttgcggctgagctactggcagacgattcgtaaaatcgttattccccaagtgatcaaaattgttttaccgtcagttggcaatgaagtcatcaacttggtcaaggattcatcgttagtttatgtcattggtctcggcgacttgttacgtgccggtaacgttgcgacagcgcgcgatgttactttggtacccttagtattagtcggaatcatttacttagcactgacagccgtaacgacttttgtgcttggacgaatcgaaaaacactacagttactggaaatagggaggccatcatatgttagaactaaaaaatattacaaaaagctttggttcacggacaattattaagaatttgaatttaaccgttaaggatggcgagattctaagtattgtgggcccttcaggtgctggtaagacaacgttattacgctgtattacggggcttgaaaaggtgaatgccggtgagttcttagtcgacggccaaccatttgacccctatactaatcggagtaacgatagtgtgattggtgttgtattccaaaattttgaattgtttcccaatttaacagtcatgcagaatattactttagcaccgaccacggtcttaaagcagtctagcgcagaagcagaacagcaggcgcagactttattagatcgtttgaatctcggtgatcacgctgaccagtatcctttcgaattatcaggtggtcaaaagcaacgagtggcgattgcccgggcattagccatgaaaccgaatgtcttatgctatgatgaaccaacttcagcacttgacccgaacttacgacaggaagttgaaaagttgattttaggcttaaaggctgatggcatgactcaaattgtggtgacccatgatttaacctttgctgaaaatatcgcggatgaaatgttccacgttgaaccaaccaagaagcaatagggggcgtcagaatgaagaaaagattatttgcactcagtttgatcgttgtgatgctcctgggtatggcaacgacgttaagtggctgtggtcaaaatgtgactaaacgcgctgacacccaagatacttggtctaaaatcaagaaacgcggttacgttgtcgttggtttggacgacagttttgtcccgatgggctttcgcgaaaagtctgggaaactagttggttatgatatcgacctcgcccgggccgtctttaagttgtacggtattaagatcagctttcaaacgattgactggtccatgaatgcgaccgaattgcgcaatggcacaattgatttgatttggaacggctacacgaaaaatccccaacgtgaaaaagtggtggctttcagtaatacttatttgaagaacaagcaagtcctcgtttctttaaagaaaaatcatattaactcatttgacgatatgactggtaagacgttgggtgttcagtcaggttcttcgggctatgagtcattggaaaacaatccgaaactgctgaaggataagattgctaagaaaacgccagttcaatacgataccttcacgaatgccttcctcgacttgaatgctggacgaattaaagggctcttgattgatagcgtctacgcgagctattatattaagcacgaagcgaactctgcggattaccaagaaacgcaaggcacctttaagtcggaagacttcgcagttgggatgcgtaagggtgacaaaacgatgaaacgcaaaattaatgccggcctaaagacgttgaaggctaacggaacgttagataagatcaacaagaaatggtttggtaatcaaaaagttgaaaactaacgtgacgtggcaggacttgtcattcagtgaccccagttatcggtgagcaactaatcataaataggctttccaagacggacgatgtcttggaaagcctatttatattggcacgcagacaaactgggattgaaggcttaaacttatacacgaaaaattgttgaaaggtgccgctataaggccaaaaacaaccagctaaggcccgctggaaaaagttcgagttttgcataaacttgcttggctagcgtcgtcctaagccgacttccaggcatttctgccaattgctggaacgcggtggacacagatttaagccgaagaccacgtcttaaatactggtcttccactaaccaagcaaagaacgcttgctaagtggaatttcaccgctgagcattggccgaaatgccttccagtcgggacagtattcgaatggcggacgaagatgtacctaacttgtgatggacttgtcattactttttataaacgataactttgtcaagcaacggtcagacagaaaatgatattgttatggttcactatttctgaaccaatgtagcaataattgaacttctcgataaacatagagatttacacctgacgctttatttgaagctccggtattaaaagaccaattacaccaagttaagtggccgttaatcagccattcgagcggcttaacgaaacgcgcgcggtgacgctgaatcctgtgcttgctacgccaacggactgatgcccaaaccgcattaatccgttgactaggcaatgcttaaattcaacccgtgatccctcgcacactttagactggaggggttgggtgacaatgctcagtagccaaattattcttagctgaaagtgggttgctttcggcttagaataagactcgtatttgagatgatgagggttgggcattagctcaaatcgacgtcggccgcgttccagcaattgtcacccagccccggaggtcggaataggacacgtacatgctgacgaacgagtatccggggtcaattgccggcacctttcaacaacaattgatgaaaaacacggccataaaaaatgcccgactagttgactagtcggacgtatgggttaatcgaaaaattctttatataacgcaataacggcttgatcggcatcattgtcgtgtacaccgaacataatagaaatttcggatgcgccttgattgaccatgattaatttaatattgtcgttggctaatgcggtggcggcacgtgacatgatgccgacgcggttgcgcatgttttcgccaacgagcattaagattgagtagtcgtgcgtaaagtaaatttcatcgggattgatggccgttgagatttctgcaactaacgttttctctaattcgggcgtcaactgatgttcatcaaagatgatggtcaaatcatcgatcccagatggcatgtgttcataactaatatgatgattttctaaaatcgttagaattttacggcccagcccaacttctttgttgagcagatacttacgtaagtatagtgaacaaaaactagaagaactggcaatcccagtcaccgggtagtggggattgggttcgcgagttgactgaatcaaagttcccggagcctcgggatggttcgtattcttgacgttgacggtaatgttgccttcgattgctggaatcaacgcttcgtcgtgaaagacagaaaagccagcgtaagaaagttcgcgcatctcagtaaacgtcatttcactaatggccgctggttttgcgaccaaactaggattgaccgcgtaaattgcatcgacatcggtaaagttttcataacgttcagcatggacaccccgagcgatgatcgcgccagtaatgtcggagccaccgcgtgaaaaggtacaaatttggccgttacgattgtaggcgaaaaatccggggataactaggatttgttcgctgttggcccacttagcgagctggtcataactactcttgataatctgagcgtcatcaggaacgtccgtaacgaccattcccgcatctttagggtcaaggtagcgagcgttgaggccgctttgttgaaaaacagcggcgaccagttgcgcattgagacgttcgccgtgcgctttgaaagctgccatcaagtaggtgttgtcggcgtatgattgttttggtaagttgcgaatcgtttcaaaaatcggagtcaattgtgcttcgggaacgttaaacccgtgaccgatttctgcataacggtcaatgatagctgcggtaacggcttgcgtatcttgatgatggatcgtttgacgggcatattgaataagtaaatcagtgactttggtgtcgccatcgaaccgtttaccaggtgccgatacaatcacatatttacgtttttgatcagcctcaacgatcgcgaggactttttgcagttgctgactactagcaagggaactgccaccaaatttaattactttcacattaaccgctccttaattttatcaataatgaaaagaatagcagacaaatcgcgacttggcaatgttaattgccactcacgagaatttaatttaatcgtgaaaataatcattttggcgaccataatctgaaaataaaaaaaacaataggacggaaagttgcgtcaatccggcctttcgcttattatttattacatatgcaaggaggaaacatgttgcaaactcagttagcaaaaggggtccaattgacgacggttcagagtcatcaatttaaaaccaaccagattattatcaattttcgggcaccgcttgcacgtgaaacaattactcagcggtcgctactatcgaatttattagaaacaagttctcgtgattatccagatcagcgagcgttagccaacgcattggctgccatgtatggtgctgcgtttggtgcgggtgttagtcgtaagggaccaacgcataacttgcaattagccatcaccgttgcgaatgaacggtatttggcaacggatcagccactgacaaatcaggccatccagtttttacaacaagtcgttttacagccgctagtggcggacggtcagtttgatcaagcgacgtttgaccgccaaaaaaagaatttggaagcggcgattatgtcggtcgctgatgataagcaatattatgctgcacagcagttaaatacggcgttgtttgcggacgaacctgcgcaacaagtgccaagttacggtacggcgagtgatttggcagccctcactgcgaaaggtttgtacgactattatcaaatgatgatccaaaatgatcaaatcgatattatcgtgacgggtgacgttgatgaggcggccgttttagctcagtggcaacaagctggttttgaggatcgactggcggggcgcccacggccattttatcaacatcataatacaaaccagtacgtcgaagtgagtgaacaacaggcactcagccaagcaaagctaaatttaggttatgatttgccagtcttttatcgtggcaatcattattacgcggccttggttttcaacgaactatttggtgggtcaccgctgtctaaattgtttatgaatgtacgtgaaaaggcgagtctggcttactatgccagcagctcattggatactttccgtggggtgcttaaggtgcaagctgggattgatggcaaaaatcatgaccaagtgttagcaattattgcggcccaattaacggcgattcaagccggtgattttacggatgatttagttgaacagctgaagctgggcttgatcaacgattttgagtccagtttggatagtcaacggacattcgctgtgcaagccttgatcgatgatttaacgcaacaacgcgttacggatactgaatggctacggcagattcaaagtgtgacgcgtgaacagatcattgcagtcgcgaagatggtgacccttaataatgggttcttcttgagtggggtaaccgcatgaaagtaaaaaaatatgatcaatttaatgaaagttgttatcaagctcagttggataatgggctgacggtgacgttgttacctaaggccggttatcacaaaacgtacgcaacgtttacaacgaactatggctcgatcgacaatacctttgttccagccggaagtactgaaatgcaacgcttcccagatggaattgcccactttctggaacataaaatgtttgagaaggctgaccatgatgcgtttcaaatttttggtcagtacggggcgagcgcgaacgccttcactagcttcacgaagacgagctatttgttctcagctacccggcacctgcaggacaacctcatgaccctcttagattttgttcaagatccgtattttacgccagcgacagttgacaaggagaagggcattattgggcaagagattgagatgtacgatgatgatccaagttggcgcctgtatttcggaatgattggtaatctatatccgaaccacccactacaatatgatattgcggggacgactgagtcgattgctaagataacggctgatgacttgtacgccgcttatcggacgttctatcatcctgagaacatgacgttatttgtggttggtaattttgatccagacgaagtgttagggtggattacgactaatcaagcaactaaaaaatttgctgcctttcaaccgattgaacgtaagattcctgaaaccgcaacggatggacatgacattattccttatcggacgattgatatgccagtcaatcgggccaaatcaatcgttggtgtcaaaggcttgctgccgattgaagcgggggctgctgctttgaagtaccgtgcagcggttaacgttttattagaattattgtttggcgatacgtcagcagattatttgcgattatatgatcagggtatcatcgatgatacgtttggttatgatttcgaattacagtctggatttaattttgtcacttttagtggtgaaacggatgatccagcccagtttgatgcagccatcattgatgtgctagaaaactggcggacggctgtagttggtcaggaagcagcactcgcattagtcaagaaggaaatgattgggcgggtcgtcttcatggcgaactccttggaggcaatcgcgaaccggtatgatcaacggctattcgggacggcgacaatctttgatgaaccgggtataattgatcagttgacccttgcagacttgcagacggttgctgaacaattattgacttctcaggcaatcagtgaataccagattcgaccacaagcaaagagttaaggaaatctgaaatttaatggtcatggggctgctaaatttagttgctgtgatatactattaaccgtaagattttgaaaatagacttagggtggagaaaaagtcaatgagtgaaaataacgaagaaacaacaacgattggggcgcgcttaaaggctgcccggacagcgaaaggcctcacaattgatgatttgcaacaaatcaccaagattcagaaacgctatttgattgcaatcgaagatgaacagttcgataaacttcccggtgatttttacgttcgggcgtttgttaagcaatatgcggaaactgtcgatttagatggtaacgcgttgttagaagaatatcgagaccaattaccgagtgttcatactgaaaccatcgttgaaaatgttgatgaagttcaacctacccgggttgctagtcgcgaacaacctgcttcaccagcgagccgcgtgcgtaattatttaccaacgatcatcgtcactgccattgtggttttgattttgttatttatttggtttatggcggttcgcacgcacgctggttcaagctctagcacgagtgcggacagttcttctgtacaagtttcgagttctaagaagcaatcgagttcgtcgaaagctagttcatcagcaaagtctagttctaaagcgtcttctgccaaggaacaaacaatcaaggctaacggcagtagcgatacggcttatactttgacgaatggtgcggataagaacaaagtggtcatcaagtctactaaggctgcttggacttccgttacgactaacggtactcagacttggcaaggaacgctaaaggcggatggctcacatacattaacgttaccaagtaatgctacgacggttaagttccagtttgggaacgcaactgccacgaccgtaacaatcaatggtaaggcgttcaattttaatccgaagaacagtacgtcacaagttcggacgattaccttgaccatcaaataacgttgcggaggaggcgggtactttgaatttacctaataaattaacggtgtttcggattattctgattccagttttcattcttattatggtgttaccccttagttggggacaggttgtgtgggctggaacaacaattccagtcacccaagtggttgcaactgtcatttttgcggttgcgtcattaactgacttagcggacggcaagattgcccggggtcaacacttggttacgaattttgggaagtttgcggatccactggcagataagatgttagtaatgaccgcgttcatcatcttagttcggttaaatgcggcccctgattgggtcgttgccattatcatgtgtcgtgaactcgcggtaacggggttacgattattgattgttgaaaataatggtaaagtgatggctgctgctatgcccgggaagattaagacaacgacacaaatgattgccatcatcttcctgctgctgaacaatgtcttatttgcggcaatccacattccatttgcggcaattatgttatatatctgcttattcttcgttatttattctggcattgattattttgttcagaatcgtgacgtgtttgcagatggcttcaaataaaattaatcatgagcgtctcaccgagtcttgcattcggtgagacgtttttgtataccattaacgtgttgcccttattaattaatcatgactcctgtcagtcgataattttaacgatgagtcgcgttggcaggttatgtcaaatgaaggtatttgaaaatgctaatctttttaatggggtcgatcgtcattttcgtatatacttaatgtaggacgctaatcatcgcgcccacactgagtgtaatcgataggattacggggaggcatatatggcatgcaagcagaaataatcgcggttggtaccgagattttactgggtcagattacgaacacgaatagtacgtacatcgcacgtggattggccgaattaggaattgatagctattatcaaacggtggttggtgataatcggcaacgtttgtcgaccgtcattgaaattgcggcccagcggaatgacttagttattttaacgggtggtttggggccgaccaaggatgacttgacgaagcagacgctcgcgcattatttgaatgttgccttggttgaagatcaggcagcaatgcaaaaaattacggcctggtttgccactaatgacaaagtaatgacggccaacaaccgattacaggcattgtatccggcaggcgcgcaaccgttgactaatcataacggaatggctgttggtgcgttttatcagtcagaaaatagtgctgatttcttgttattgccaggtccaccccgtgagttagccgtaatgtttgattctgaggcaaaaccgaaattggcagctgcatatggggaacaagcccaaatctattcgcgagtgatgcgtttttatggcatcagtgagtctgaattggcgacccggttgcaccccttgattgatgaacagcaggcggttacgatcgcaccctatgccaagactaacgaggttaccctcagattgagtgcccaagctatgacggaaacggctgcaaggggaatgatcgacaaagttgaccaccagatcaaggctaccattgggccgtacttttacggttatggagacgataactcgttagttactactgttattaatcaaatgattgcggctaagctgagtattacagccgctgaaagcttaacagctgggctgtttcagagtaccatcggcagtgtgtccggggtctccgcaatctttccgggcggctttgtaacgtatgcgaatgaggccaaacatcagctagtgaacgttccacaagcaattattgacgctgagggcgtggtttcagaagcgaccgctaaggccatggcgagtggtgctaagcagcagctaaatactgatgttggtatcagttttacaggcgttgccggtccaggaaccttggaaggtcaaccggctggaacggtatggattggtcttgcttaccgtgatcgacccgtgaaggccaagcagtaccattttgctggtaatcgacaacaaattcgggaacgcagtgtgatggccgggttagacctattgagacatgcattgaatgaagatacggacttaaaaaaataatacgaacttttgttcgctttttgcttgcaattctaactttgaacagctatgatattaagagttagaaacgagcaccaaaggaggaaataatttggctgatgcacggaaagcagcactagatactgccctgaaaaagatcgaaaagaatttcggtaaaggggcgattatgcggatgggtgacgctgcccagacgactatttcaacgatttcaagtggatcgttggccttagatgacgcgttgggtgtcggcggctacccacgtggtcggatcgtggaaatctacggtcctgaaagttcaggtaaaacgaccgtggcactacatgcggttgctgaagttcaaaagcagggtggtacggcggcctatatcgatgctgaaaacgcactagaccccgtttatgcggaacacctaggggtcaacattgatgacctgttactttcgcaaccagatactggtgaacaagggcttgaaattgcagatgccttagtttccagtggtgcggtcgatattttagttgttgactcggtggcggccttagtgccacgtgccgaaattgaaggtgaaatgggtgacgcacacgttgggttacaagcgcggctgatgtcacaagcgctccggaagttatcagggacattgaacaaaaccaagacaatcgcgttatttatcaatcaaattcgtgaaaaagttggtgtgatgtttggtaatcctgaaacgactcctggtggtcgggccttgaaattttacgccacgattcgtttggaagtacggcgggcagaacagatcaaggaaggaaccaatattattggtaaccgtgtccggatcaaagtcgttaagaacaaggttgcaccgccatttaagcgtgccgaagtggatatcatgtatggtcaaggtatctcacaaactggtgaaattgttgatatggctgctgaaaaggatattgttaagaagagtggttcttggtattcatatggtgacgatcgcattggtcaaggccgtgaaaatgccaagaagtatttggacgagcatcctgatgtcatgacggagattcgccaaaaggttcgtgatgcatatggtatggatgcaactggtgaagaaacgtctgaaactgatgatcaggccaaagaagctaaggataagggaactgctaagaatggcagtaagggtcaaagtaagtccactaaagcgacaccagcggaaactgctctcgatctcggcgaccaaccaaccgaaaaatagacagtttgttatgcaacgcccaaaatatttattttgggcgttttttgtacatacttagcttgtttgcacgacaaaagtagcctgcagagagcggttgccataagactttaagttgacactattcgtttctaacattagaataacaagtgtgtaaataatcaaaatataacatctgaaaatttgtagttgattttatgttaactggattttggtggtgcggaggtggaaacatgaatgttttcggtataatcctcgcagtcatcgcaattgttgtcggttatgggattggttactatgtacgcaagaacgtccatgaaaaagaattggacgttgccaggaacacagccgaaggtattatttctgaggccaaacgggcagcggagactcataagaaagaaaaagtccttgaagctaaggaagagagtcatcgctaccgggctgaagttgaaacggagttaaagcaacgtcggaatgaagttcaaaagcaagaagaccggttgcttcaacgtgaagaaactttagatcacaaagagaatacttttgaaaagcgcgaggatgctttaggtaaaaaagaagataagattgccaatgagcaaaaacgcgttgaacaacagcaacaaagtgcagcttcactaatcacgcaacgtcaagctgagttagaacgggtcgccgccttgtcgcaagaacaagctcgcgatcagattttgacccaaacgcgcgaacaattaacgcatgaacgggccgtgttaattaaagaaaatacggacgaagtgaaagcgcagtctgaaaaagaagccaaaaacttaattgtccaagcgattcagcaaagtgctgccgatatggtttctgaaaccacggtttcggtcgtttctttgccgaatgacgacatgaaaggccggattattggtcgggaaggtcgtaacatccgaacgttggaaacgctgacgggaattgatttaattattgatgacacgccggaagccgtcgttttaagtggttacgatccgattcgtcgtgaaatcgcaaagatcgcgcttgaaaagctgattcaagatgggcggattcatccagctcgaattgaagaaatggttgaaaaagcgcgtaaggaaatggacgaaaagatccgtgaaactggtgaacaagctgtctttgatttaggattgcacgggatgcatcctgacttgatcaagcttgttggtcggctgaattatcggaccagttatggtcaaaatgttttgaatcactcaattgaagttgcgaagttagcgggcgttttagccgctgaacttggtgaagatgttacactcgcgaaacgcgcaggattattacacgatattggtaaggccgtcgatcatgaggtcgaaggttcccacgttgaaattggcgtggaattaacaacgaagtacaaagagagccccgtcgtgattaacacgattgcctcccatcatggtgatgtggaagctaagtcgattatcgcggtgttggttgcgacgtctgattcaatttcagccgcccggccaggtgctcggagtgagtcgctggagaattatattcatcggctcgagaagctggaagcgatcgctaataatgaggatggcgtcaagaagagctatgcgattcaagctggtcgtgaaattcgagtcatcgttaagccaaatgagatttctgatttacaggcaacggttttggcgcacgatgtcaaaaagcagattgaaaatgaacttgaatatcccggtcatattaaggttacggttattcgggaagttcgagcagtggattacgctaaataaccgggaaatgagtttaggtcttgacctaagctcatttttttagttgccagcagaattcaatcacgttttcaaggctaaataatgctaaaataattggtataacgttaaaacaagggagcaatctatgcgaattctatttgttggggatgtcatgggcaatgtcggccaaacggcggtcaccacgtacttacctaagttaaaacggcgctacaagccacaagttactattgttaatggggaaaatgccacccgcggccgcggcattaatcaggaagtgtataaggacatcttgactgcgggggctgatgtcattacgatgggcaaccacacctgggataataatgaaatctttgattttattaatggtgctaagaagttgattcgaccgttgaactttccgccagcgacgactccgggggttggttatacgatcgtgaaggtcaatacggtgaagttggccgtgattaatcttcaaggaaacgtctttatggggcaaaatttagcggatccttttacgactgtccaaccattggtcgagcaactgcgggaagagacacctaacatcttcatcgactttcacgctgaaacgacaagtgaaaaggaagccatggcgtggtatttggatggtcaggtgagtgcggtagtcggcacccatacccatgtgcagacgagtgatgaacgcgtattgcccaatggaacggcctttttaagtgacgttggttttacgggtccgtataatggtattttaggaatgacccgtgagaatgttattcagcgtttcttggaacaaatgccgacccgtttcaacgtgcaagaggatagtccggcagtgttgtcgggttgtgtgatcgacgttgatggtcagagtggtcgggcgaaaaagattgcccggattttgattaatccggaccacccatattttgatgactaagatttacgatagaaagtaggattaagcgtgccacagaaaacaaaagatacaccgatgatgcgtcaatattttgcagttaaaaatcaatatcccgatgcgtttttattttaccgacttggtgatttttatgaaatgttttttgatgacgcgattaaaggtgctcagttattagagttgaccttaacgacgcggaatcattcggcggaaaaccctataccgatgtgtggggttccccatcgagccgtgcaaaattatattgatattttagtagataaaggttacaaagtcgctatttgtgaacagatggaagatcccaaattagccaagggcatggtcaaacgcgaagtgattcagctcgtgacacctggtacgacgttggaacggggcgcggaacaagctaagacgaacaattacttgactgcgctgattcagcgtgatcaacaatatggttttgcgtacgccgacttgtcgactggggaactaaaaacgagtgtcttaacgactaacgataccctaattaacgagttgaccagcttgcaaactaaagaaattgtggtcgacgactctgttgctagcgatttgcgcgatcaaattaagacgctaggaattctaatttcagaacagaataacgtcaccccccaggctgaattgagctacttgactcaggacttgacggtcgatttggaacaacaggtcgtggaacggttattgatgtatattacggtgactcaaaagcggagcctcgcgcacttacaaaaggcgatcgcttatgagccgtcatacttcctgaaactcgatcataattccaagtataatctggaattaatgaagtccatccgaactggtaaaaagcaaggaactctcctgtggctattagatgaaactaagacggcgatgggcggacgactattaaagcagtggatcgaccggccattgattgtgaaggccgatattgaaacgcgtcaaaataaggttgcgacgttattagatcattattttgaacgtagtaacttacaagaagagttgactaaagtttatgacttggagcgtttagctggccgggtggcttttggtagcgtgaatgggcgtgacttagtgcaactcaagacatccttgcgtcagattccaaagattcggtatatcttatcggaattagatacgcaggtatttaatgatgaagttaatcagctggatccagtcgaagacgttgcggatttgattgacgcggcaatcgttgaagacgcgcctttgtcagtaacggacggtggtgtgatcaaggatggttataacgagcaactcgatcaatatcgggatgctatgaataatgggaaaaaatggattgctgagttggaagcccaggaacgggcgacaaccggtatcaagaatcttaagatagggtttaaccgggttttcggctattatattgaagtcacgaaggccaacttggcccaattaccgaaggaccgctatgaacgtaagcaaacgttaacgaatgctgaacgctttagtactcctgaactgaaatcgcatgaaagcctgattttagaagctgagagccattctacggatcttgagtatcaactcttcacaaaggttcgtgaaacggttaaaaaggcaattcagcggctacaaacattggcgaaggcggtcgcagcaattgatgtcttgcaaagtttcgccgtcgttagtgaagattaccactttgttcgaccgaaattaactaaatcacatgatttgaagatcgttgatggtcgtcatccggtcgttgaaaaagtgatgggtaaccagagttacgtcccaaataacgtgacaatgtcacctgatgagacggtccttttgattactggtcctaacatgtccggtaaaagtacgtacatgcgtcaattagcattgacggtcatcatggcgcaaattggttgttttgtaccggctaaatcagcgcaacttccaatttttgaccaaatttttacacgtatcggtgccacggatgacttaatttccggtcaaagtacgtttatggtggagatgcaggaagccaataatgccttgcaacatgcgacagccaatagtctagtgttgtttgacgagattggccgggggacggcgacttacgatggcatggcgcttgcccaagcaattattgagtttgtgcataaccatattcatgccaagacactgttctcgacgcattatcatgagttgaccgcgttagatcaagaattatccgggttacgaaacgtgcatgtgggtgcgactgaacaggatggcgagctcgtcttcttgcataaagttgagcccggggccgccgataagtcctacggggtgcacgttgccaagttggctgggatgccaacgagtttattggaacgggccaataagattttaacgagtttggaaaatcaaacgagtacggtatcgacgacagcggcttcgattgctgctagtgatgctgctaatagcgtggcacctaacacagcggcttcaatgccggttgaggccgccgatgagtcacagccagtagaatcggagaccccggttgccgaagctccggtcgctgaagccggtgatgaacagctgtcgttatttgctgagccggcggtgacggatgcgaagggtgaaaaggttttacaacagctgaagacgttgaacttgatggcgatgactccgatggatgtaatgaaccagctgtataaatggcaacaaaaattaggtaagtaggcgcattttaactcatcataaatgagcgcaataagctgttatgatgagctattggtgcgtctgacggacaggtaggtcgacactagtcagttattgctagttgtggtaatcgaaaatgttcgtgcaggacacgagcttaattattttatgtgaaaggaccgatggaaatgggaaaaattcatgagttatcttctgtgctggccgaccagattgctgccggcgaagttgtggagcggcccgcctcggtcgttaaagaactggttgaaaatgctgttgatgcgcacgcgacgcaggttgatattttggtgcaagagtcgggtgttcagtcaattcgggttatcgatgacggtgacggtattgatgacgctgaagtcctgaccgcttttaaacggcatgcgacgagtaagatcacatcacgtgaagatttgtttcgcgtccattctttaggttttcgcggtgaggcgttgccaagtattgcgtcagtagcggacgtggtgatgaatacgagtaccggcgccactgggacgagtattcattatcgcggcggtaaactattacaacaatcgcccgctccgttgcggcaagggacggacattaccgtcactgatttgttttttaatacacctgcgcgactaaaatatttgaagtccccccaaacggaattagcgaatattttagacgtggttaaccgcatcgcacttagctatccagcggtggcatttcggttagttcataatgcgaaagagctattaaaaacggctggtcgcggtgacttacaacaagtcattgctggtatttacggtgtccaaaatgcgcgcaagatggttgccattcaaggatcgaccactgattttaaattgagtggctttgtggctttacctgagctgacgcgggccagtcgccagtatattactgttctgattaatggtcgtgctatcaagaaccagcaattgaccaaagccgtcatcaaaggttacggttctaagttgatggtcggccgttatccaatcgcggtgatcgctttaacaatggatcctttattggtggacgtcaatgttcatcccacgaaacaagaagtccgtttgagtaaggaaccagaattagccaaactggtcagcaccacgattacggaccggttagtggatgtgaacttgattccgtcagcattgaccaatcttggcagccatcggcgtgaacatctaaatacagaccagctggcgatggatttgaacgccatttcgtcacagtatcaagtagcggataagacaacgccggcatcgactgagcagtttgcagcctcgctggcagcggcaaccatgcagcccagctcggcaacgaccatggtaagtactacttcagcacagccatcagcggtaaaccgtgcagcagttagtgcggttgttccgtcagaatcagcggcaagttctgccaacccgccgattatgattagccatcgcgacgaactgacagctactccagttcaagcatttgaccagcgttaccagtcagaatcaggcgctttaccctttggtgaaactgctgaaccgttagaaaccagcacggctgcaagcgcgccgactagtgaagcgccggatacggaacgttttccacagttacgctatcttggtcagatgcacgggacttatctgttagctgaggcggatgatggtatgtacattttggatcagcatgcggcccaggagcgaatcaactatgaatattatcgccaagcgataggtgaggttagtgcggatcaacaaaatttattggttccgattattttagattacccgacgagcgatgttttaaagatcaaggaaaaattgccgttactagcagaattagggattcatctggaatcattcggcggcaacagcttcattgttcatgcccatccgacctggttcaaagctgggcaagaagaagatacgattcgtgaaatgattgattggctcttacaggatgataagttgacggtcgcccaatttcgggaaaagtcagctatcatgatgtcctgtaaacgggcaatcaaggccaatcaccatttggatgatcagcaggcccgcgcgttattagccaagttaccgacctgcgagaatccgttcaattgcccacatggccgtccggtgacggtacacttcacgaattcagacatggaacggatgttcaaacgaattcaggatagtcatgaagcacgtgattaaagtgattattggcggcgtactcgttactttagtatgattcgtaatcgatccgcattgtgcaagtaaatatttcatgaattatgattaaaacgtgccaagtttagattgttgttcgtcagccggtgtgcgtcctatgccgacctccggggctgggtgacaattgctggaacgcagccgacgtcgatttgagctaacgcataacccgcgtcatctcaaatacgagtcttattctaagccggaagcagaccacttccagctaagaataatttggctactgagcattgtccacccagcccctccggtcgggaaactgctcgaatggctgatgaacgaccacctaatttggtacaattagtcgctgactattttgatgctggaagtttaaacaaagcgctaggtgcattaagcactctgtcaagagattaaatcctactataccgattcaggattagtgagccatctcaatattatttttagtctgacagttgattgacaaaattaccgtttatgaaaagcaacgaccaattcatcaaaagttgggtacctcaccgtctgccattcgaatactgtcccgactggaaggcgtttcggccaatgctcagtggtgaaatttcacttagcaagcgtcttgtgcttggttagtgaaaggccagtatttgagacgtgatttttcggctcaaatctgtgcccaccacgttccggcaattggcagaaatgcctggaagtcggtgtaaggcgcacacaccaagcaagtctacgctagtccgaactttttccagcggtcttaagctggttgcttttgaacttaagaaatggcacgttttaatcatgactgatactgaataatcacgaaccgaatgtgttatcgaataaaaatagcaatgttgagtagtccctgggttaaaaaacctagggacacttttattgtcgccagtattgcggtctaaaaaacaactttaagattggggaagtggcgtttgtgacactaatttgagttgtaaaatttcagattgaattggtttaaatagttagctatcattgattaaaatgagtggtgagcgcgtatcgggtgcttggaccactcaacatgattgggagttgattgttttggatatgaccaaactttattatcgccaggtttattcggcatattgttttttggcagatttaccagaggccacgcccgcgttcgtggccgggcgcaagacgctgtgggaattaaatgcgcatccaagtgcgcgggacgccaaattgattacgctgaatttatatgagcaagttgctgcttttgagctcgatcctaaccgtcatgatcaagcggcaatcgctacgatcaacttacaacgtgataatgctgtgagtggcttacaacctttagtacagttgtttgggagttatccggcgactactaagattgaaactttagataactgggattggcgttagttgttgatgggacagctgtgaatcacgaatttattaagattcaaactgaacatcacgagacgaaattgttcatggtaaaatagaaacattgtttgagatggcaaaatatggggattgcgttgtcgacgtaattacaagataggggcacctgatttgaagacagtacggaagataccactagtcgtctggtatacggcgatgtttgtggttattgcgacgattacttacagtgggcttttcttagccggccggacattgatttgggaagtggatggcatcgcccaacacttcccgattttattggaatttcagcggatcttacagcaccacccacaacaattattcagttggtcatggaatctcggcttgggggccgatcaactgacgactttttcctactacgtggtcggtgatccgtttaattatttagtggcgtttgtttcgcgcgctcatttggaatgggcctaccaagcgttgatcttgctgcgattgtacttcgttggacttacttttctaggtttcagtcggcagttcaagttcaaacgtgtcagtcaattgattggagctttgacgtatacgtttaccgcgtatacgttctatgttgggatgcaccacccgtttttcttgttaccaatgatttggtttccgctactgtgttgggcgattgaacgggtcttacgaggccgacattggttaccactcagtctgattaccgccgttgtaattttgagtaacttctattttgcttacttactcgcattgggcggcttagtctatgctttggtgcgtttctggtcacgtcgtcgtgatcatttaacgatgcggtcgtttggacagttattttggcggttactagtggcggttggtcttggtgtcacgatggcaggcatcttactagtgcccacgctgctcgcgatgttgacggcaacgcgtgcgagttttaactttgcgaatggcttgacaagttatcccatcaattattacgttaatttacccaatcgactgttgaccaatggtggcagtgtccaatactgggtgaccctcgggctgagtagcattagctttattgcaattatttatacactacgtcatttcagacgctattgggtgcttaattgggtactggtcgtgatgatgttgggtattttgttgcctcaatttgcggccgtattcaacgttttttcaacaccttctaatcgatggttgttgatggcaaccctcgtgtttgcttatgcgacgatggcatttatggaccaagtcactgctctgacagcggctgatttaaaatggttggctggtattagtggcggtctgcttgtcattatttggctgatcaatggattctatctcaatatccgcaaacatgatattgcgacatatctcatcttgttagcgttaattggggtcctgctggccaaacaatccttaaaattgaccaatcggcaattttatgtgttattactgggaattgtcacgctgaacctggcgaataacggactgggctggttgagtatcaatactaattctaatagtactgagcagttgcggcagggcgcggcaatgaaatgggtcaaaaattattttgatggcgcgcaaaaaagtttaaccacgactagccaattttatcgaacggctttggcacccaactactatacgatgcgttcggctgagagtgatgtgccgatggtgttaggaactcacacggttggatcgtatttttcagttcaaaatggttacgtgggggcatttagtcaggccttaggcaactcagagtatgcgatgaactcgccactcggttcgttggacggtcggacgacgatgtataacttattaggtgttaaatatttatttgcacgtgaggaccagttgaagaaacaagccttaccagccggatatgaggttgttaagatgaaaactggcgaaccgaagatttttgcggacaagtttatttatggcatgagtaatcataccggcacgatcttgttaaaatccaagaatgcgttgccgttagtttatacacagcagcatcagattagtcaacgccaatttaatcgcttgaacgcagttgaccgcgagcaagccttgttacaaggtgcagtcactacgcagcaggttagtggtgttaagactgtcaagccaaccgttaccggaaaaaacgtcgcttatacggttcaagcggatacgacgaatgttttggatacgttggacaaggtgattatttaccgcaatcaacatgcaacgggagcgtcgaacaacgcgttgactaagttaccggcagatacgatcacattaacgccggaacaacgagaaagtttgacgccggcaactggcctgacgacaccgtcaaaccgcgtgttgaacttgattgcagctaatcaaaagttagtccagaaaaatcaggaaaacaatgccgacgagttaacgagcatggtcagtgatgtgcaggggcaccagataccgtaccaattgaccattcaacaccctaagaagtatcgaaatacggaactctatcttgtgctagatggcatcagttatcggcgttcctcaatcaagcacgccttgacaacgagtcaaaatatcaacgtgttcacggcccgtccgtataccaaagtcgattatctagatgatgttcgcgatggtctgaagggcaatttgagcgctagtgggtattctttaactgctcagacaacggataacttgacgagttttagtcagttgggtaccacgaatatgtcagactatgagccccggacatcagcagtaatcaacttagggtatagcaagtacgcgcgtaagctgattacgctgaactttacgagcattcgtagtttgcattttaagtccgctaaactgatcgctgtaccgcttgggaagacttatcgtcaacggacgcggcaactacagacgagtgggttgaagcatcaacaagtgacgaacaaccagattacgggaaccacgctgactaagacagcaaccgtgttaacaacgtcaattccgtattcgactggttggcagctacgagttgacggtcaaaccgttaggactcaagttgtcaacaaagggtttgtgggggccaagttgacagccggccggcaccagattcgattgacgtatcacacaccaggactaaaaatcggcatatggtcgagtattattggtggtgtgattagcatactgattgcctgctggtgggggcttcacaaacgtgtcagacaatcttaattgagtaaatcggtattaaaataggcttcttaggaattaactttgattcctaagaagcctatttaacgttagatggaacacaaacgaatgtatgccatagcgaaattcacaattaacagccacgactggttaattatgaggttgtcgctaacgcaattaactgttcgggaatgactggtgcggtggctaatttttgccattcactggttgagactaacatgacgagtggcgtgctgaccgttgtcaaccacgttttctgcggagtaacgggtgccatggccgttgtgatgtcggtattgacctcagactcagtaatctgccaaagtcgatgtgtgacgtgcgcggtatccgtcacctcgacgaccggggcaaaatgaccgacccagtcgtcaatcaacatctcgataacgggttgctgtgggtaaaggactgtgttgatcatgccgggaaccatggtcgtcacggtttgatccaccggccagctgccaattaagcgccactggtgaacaccgttgagtgtgagttcgtaccagtaatagctggcttcggttgtcgtcattgtatcctggctgtcccaattggtcgcagctgtttgaattttagtttgaccagttgtggtcggtaacaccgctttaaacggtttgagttgcatagcgagacctccctaggactttgagcatagcatgacgttaacgtggcggcaagcatttcttgccacgaaatccgtcaatcgaggtgaaattgatttaacattaaaatttggtttttatcggtggaccagtgttaagccactgtgaaaatgtggtacaatttagcaagcaaacatacgttttatttaaaggagttttttcggtgtacgaatattttctcggtcaagtgaccgatgtaacccccggttatgtggtgattgaggtcagcggcattggttataaagtgctaacggctaatccataccgttaccaggtgggcccaacagcagttaagatgtatatccatcaagccgtcagcgaaaatggcatgagcctatttggcttttttgatgctgacgagaaggcgttgttcgaaaagttgctcggggtttcgggaattggtccgaagtcggccctcgcgattttggccaacaacgaccatgcaggtctgatccaagccatcaatcaagagaatgcgacttatctgacgagttttcctggcgtgggcaagaagacagctcagcaaatcgtgctggacttgaaaggtaaattaaacgatctaaacgttgatgttactggtcaaactgcgctcgatgtggatgctcctgctgttgatggcgcgttagcggacgcgttggcggctctggaagctcttggctattcgaaagcggatgtcaagaaggtcactaagaagttggagacgtttagtcagacacaaggggccgatacgaacaccttgttgagtgaaggactacgactattgatgaagaagtagatgggaggggtaactaaatggacgatgacaagttattatccggtgacaaagccgatgacgaagaggcgtcattagaaaaatcgctccgtccgcaaacgttagcccagtatattggtcaggcccgggtcaagcacgaattaggagtgtatattgaagcggcccgcaagcgtgaggaatccttggatcacgttttgctgtatggtccaccgggattagggaagaccacgctagcgatggtaatcgccaacgagatgcaggtcaatatccgcacgaccagtggccctgcaatcgaaaagccaggtgatttggttgcgctcttgaatgaactggagccgggtgatatcttatttattgacgaaattcaccggttaccgaaaatcgttgaagaaatgttgtattcggccatggaagatttttttgtcgatatcgtggtcggacaggggccaaccgcccatcccgtgcactttccactgccgccgtttacgctgattggcgcgaccacccgagctggtatgctgtcagctccgttacgtgaccgatttggaatcgtcgaacatatggcgtactatgaagttgctgatttggaagatatcgttaagcggactgcagatatttttcaaacgagtatcaaaccatcgggtgcccacgaaattgcgcgtcgctcacggggaacgccccgcattgctaatcgcttgttcaagcgaattcgtgattttgcagaagtggcggatcaagatgccattgatgaggccattgtggcgcgatcactgacatatttacgcgtagatgatgccggcttggacgagactgacaataagctcttacgaacgatgctagagtattatgacgggggtccggtcgggcttgctacgattgcggccaatattggtgaagaaacggatacaatcgcggaagtggtcgaaccgtacttactccagattgggttcttgaagcgaacacaacgtggacgcgttgttacaattaaaggttatcagcatttgggattcccatacccagaaaataaataaagataagaggtcacaacatgagtttaacacttgaagattttgattatgatttaccacatgaactgattgcccagacaccaatcaaaaaacgggatagttcacggttgttggaattggatcgccaaacgggcgaaatgcaagataagcatttctacgatattattgatcaactcaatccaggcgatgcggtcgttatgaataattcccgcgttatgccagctcgtttgtatggtgttaaacctgaaactggtggtcacgctgaagtcctattattgcataatacggaaggtgatgaatgggagacactcatgaaacctgccaaacgtgccaaggtcggtaccgtgatctcatttggcgatggtaagttgacggcgaccgtaacggccgaaaaggaagatggcattcggatgatcgagtttcattacgatgggatcttcatggaaattttggagagcctgggtgaaacgccattgccaccatatattaaagaaaaactcgatgatccagaccgttatcagactgtttatgccaaggaaaatggctcggcagctgcgccaacagctggtttacactggacgaaggaactcttacaaaaagttcaagacaagggtattaagttggtttacttgacgctgcatgtcggactagggacgttccggccagttgaagaagataatatcgatgatcataagatgcacagtgaattttatcgattggacgaagatgctgctaagacgttgaatgaagtacggcaaaatggtgggcgcatcattgcaaccgggacaacgtcaatccggacgttagagaccattggtagtaagtttgatggtgaaatcaagccggattcgggttggacggatatctttatcaaacctggttatcaatggaaagtcgttgatgcgttcatcacgaactttcatttaccgaagtcgaccttggtcatgttagtggctgcctttacgggccgtgatatgattttgaaggcttatcaacatgcgattgatgaaaagtatcgcttctttagttttggcgatgcgatgtttattcactagtataactggctttaaacgagatcgcttattttgaaacggatgacggttgaatattaaaatgccgtattatacgaggcgtatcgctaatttcaagctgccgttttagctctggagataataaagattgtcaatagtcgcttcaagaagttaaaatgcattcttgaggcgactatttgacgtttgaacgctttgttaacagactgactaaagccacgtgggtgcccacgccaattgccgcgactggttcacggctggatttcgtgctatcattatttgagtttagcaacattttaatacggaggaacagatatggaaccggcaattaaataccgattaattaagaaagaaaaacacacaggagcccgccttggcgaattgattacgccacacgggacctttccaacaccgatgtttatgcccgttgggacgcaagccagtgttaagtcactggcacccgaagaattagacgcgatgggtgcgggtgttatcttatcgaatacgtaccatctgtggttacggccaggcgagcaaatcgtgaaagaagctggcgggttacatcagtttatgaattggaaaaagggaatcttgacggattcaggtgggtttcaagtcttttccctggctaaaaaccgtgatattacggaagaaggggtccactttaagaatcatttgaatggctcaaagatgttcttatctcctgaaaaggctattcaaatcgaaaatgatcttggcccagatatcatgatgagtttggatgaatgcccaccattctttgaaagttacgactatgttagcaagtcagttgcccggacaagtcgctgggcagagcgggggttgaaggttcatcaacaccctgattaccaaggcttatttgggattgttcaaggtgcgggctttaaagacttgcgtgaacagagtgccaaagatcttgttagcttggactttccaggctactcgattgggggcttatcagtgggtgaatcgaaggctgagatgaatcatgttttagacttcacgacgccactattgccagaaaataaaccccgttacttgatgggagttggctctgcggatgccttgatcgacggtgcaattcgtggggtcgatatgtttgactgtgtcttaccgactcggattgcccgtaatggcacttgcatgacgtcccatgggcgtttagttgtcaaaaatgcggcctacgctcacgatttcaccccgttagatgataattgtgattgttatacctgtcgtaatttcacgcgtgcttatattcgtcatttgattaaggcggacgagacgtttggtttgcgtttgacgagttatcataacttatatttcttgttacacttaatgaagcaagttcgtcaagccattatggatgataatttactggagtttcgccagaacttctttgaaatgtacggttttaacgataaaaacccgaaaaacttttagtgctactggtatttcagaccgtaatttgttaaagttaaagatagtcaaacttttaattagagtaggagcgatattaaatgggtcaaatggcatcaattctgtttatcgtggtcatgttcgcattcttatacttcttcatgatccgtccacaacggaaacaacaacaacaacatcaacaaatgttaagcaaaatcaaacgtggtgacaaggttacgacaattggtcgcttgcacggggtcgttgatgaagttaacgaaaccgaaaaaacagttactttagactgtgatggcatctacttggtttttgatttgaacgctgttgctaagatttctccagccgaagatgcacaagctaagacagttgcaccagaatctgggacagcggctgaatcagctgctacttctgaagttgaatcggcaagctcagccgccgacgataatgctgattctgaagcaaaataggtttacaccataagtggtcgatcattgctgatgaccgcttatttttttgctcattttttggtcttgaaacgcgcttttgaacgtatgttcgtgtataatgaaagtactaaggattggaggggcggcggatggcacagtcaattgttgaagcgcctattcgggtggatacgagtcggaaaattattcatgtggacatggacgcgttttatgcgtcaatcgaagagcgggagcatccagcctacaagacgcagccgttagtgatcgcgcatgatcctcggcagacaggtgggcgaggcgttgtgacgacggctaactatgttgcccgccaatttggcgttcactcggcgatgccagctgctaaagcattagaactctgcccaacagcagtatttaagacgcccaactttccgttgtaccgcgaagtttcggcgcagattcatcgtattttccatgagtatacagagatgattgagccaattgcctttgatgaggcttacttggatgtgactacgaataagaaacacatccatagtgcggtcgaactggcgcaccgattacaacaagaaatttggcatcaaacacatttaacttgttcaacgggaatctcctacaacaaattcattgccaaactagcatcagattatcgaaaaccagcgggtgtgacgatcgtattaccacaggatgcagaaccatttttgttacgtgaacccatcgagaaatttcggggtgtcggtaaaaagacggtacctaaaatgcacgatttaggaatcaagactggacaggatttatacgcacagtctgaattagacctaatcaaacaatttggcaagttgggctatattttataccggcgagtgcgcggcagtgatgatcggccagtcgagtatttacgtgaacggaaatcaatcggcaaagagcggacgtttggaccgtttctccaatcgacgacggaagttaatacgcacttgaaggccatcgctaagttggtagcagctagcatgcaatcgcatcagcgccacggtaaaacactcgttctcaagttgcgttacggtgactttgtcacaattaccaagcggcgaacgttcggtgaattcatacctaatgacgcggccttgtttgagcagtacgccgaagagatttttgaagaggtggtcgatgatcattttaactctggcatccgcctgttagggatcacgctaactggcttggcaccactggcgtttgagaacttaacgttaccactttatccaaatgataattaatttatttggcgcgacgcggattcttcggtatactggagtactgtgacagtttaatcgccaccagtaaattatgagagtaagaaggttcatttatgaccgtccaaacagcaatttttgacttaattaaacaagcaaaaacaatcatcattcatcgtcatcagcgacctgacccagacgccatcggaagccagttagggttagcagctatcattaaggctagctttcctgcgaagcgggtattgacacctggaaaacagtaccatggttttgactggttaggacaaatggatgaggttaccgaagcggactatcaagacgcactagtattaattcttgataccgctaatcagccccgaattgatggtgaactttggaatcaaggtaagacaattgttaaaatcgatcatcacccaaacgatgacgctttcggtgacccacagtgggtcgacgttgatgcttccagtacgagtgagatgatttataattggtacgcaccccttgcggcggagttaacgctaacggctaacgccgctcggttgttgtatgccggcatcgttggggacaccggtcgctttctatactctgcgaccaagcctagtaccatgcgagcagcagcggccttaatggaagccggtgcggatgctgaagctgtcaatcgtattgaagataccatcacgttaccagtcgcacggttgtcggcctacgtttatgaacatctgacacagttggattcgggtgcagcttacgttattttaacgaatgcgattctcgattcatttgcaatcggtgatgctagtactgctggggttgtcccattacctgggcgtattgatacggttaagtgctgggcgatttttgttcaacaaaaggaaggtgacttccgtattcggttacgttcaaagggaccgtcaatcaacggtgtggccaagaaccatgatggtgggggccacgcattagcgagcggtgccaaggctaaagaccaacaagaaattgaaacggtagtgcgagaactcgaccaagtcgctagccattatgagaaagaggtttaaatatgaccgcaagttttgaagattttaaattgcagccgttcttgatgcaggcactgactgacatcaatttccgcaaaccgactgcggtacaggaaaagttgattccagtgattgctgctggccgcagcgtcatcggtcagtcagcaactgggagtggtaagacgcatacgtttttactgccaatgatcaatcaactgaatgctgatgaacgttacgtgcaggcagttatcacaacgcccagccgtgaattagcttatcagattcagactgctgctaaacagttgatccaacacagcccgaaagccattcacattggactctatgtcggtgggactgataagcaggaacagattgaaaagctaaatcggcaccaaccacagttgattattgggaccccaggacggattctggacttaatgcgctcccaggcactcgatgtgcatcgtgcgactcagctagtagttgatgaagccgatatgacgctagacttgggctttttgaacgtggttgaccagattgctggccgaatgcctgctgatttacaaatgttggtgttctcagccacgatgccacaaaaattaacgccatttttgcgcaagtacatgaacaatccagttatggaagaaattccagtagaatctgtgattagtccgactattgataactggctgatttccaccaagagtcacgataaaaacagtattatttatcgcttgctgacgattggtgaaccgtatctcgtgttggtttttgctaacacgaaggaacgagttcaagagttgacccattatttgcgccaacaaggtttaacggtcgcaatgatccatggagatattcaaccacgtgaacgaaagcgggttatgcgcgacgtccaacaattgaagtatcaatttgttgttgccactgatctagctgcccgtgggattgatattgaaggtgtttcacacgtcatcaatgatgatattccgaatgacttagaattcttcattcaccgtgttggccggaccggccggaatggaatggcggggactgcgattacgttatatagcccaggcgaagaagccaaggtcagtgcagttgaagcaatggggatcaagttcaaaccgaaggcgattcgtgatggtgagattgtggattcatatgaccgtaatcgtcgggctaaacgggggccaaaacaggaaaaactggacccaaccttgattggttacgtcaaaaagtccaagaaaaagatcaagccgggttacaaacgccgcattcgtaaaaagatcagcgataaggcgcggatggaccgccgcatcgaacaacgagcggctgcccgcaaggaacgcaaggatcgtaagtcttaattgacgtgcatccggatagattaatgcaaaataactgagtggtgtattgacaagtcgccgcaagttttctatactttgcaaagtaaggacatatctatctcacatatcggtcaagaaacactttggttgctggaaaaagtgcggtgtggggtagatgctacctagaagtaatgactagcaaactagtccgtgtctcagcgttaatgagcttaagaggtaaacgaacacatcgttgcaagcagagtggtaccgcgttaacagcgtctttgctagcaacggtgtttttttgccttaaattaagaatgatagagaggatgccagaattaaatgaaaaaattaagtagtagtgaaattcggcaaatgtacttggacttttttcatgaaaaaggtcatacgattgtccctagtgcatcactagttcccgtggatgacccaacgttattatggatcaactccggtgttgcaacgatgaagaagtactttgatggctccgttgtgccggataacccccgcatgacgagttcacagaagagtattcggacgaatgatattgagaatgttgggcggacggcgcggcaccacacgttgtttgaaatgcttggtaatttctcagttggtgactacttcaaaaaagaagcaatcagttgggcctgggaactcttgacctcaccaaaatggtttggctgggatcctgacaagttatacatgactgtttatcccaaggacacggatgccgcgaaattctgggaagcaactggcgtgaaaccagaccacatcattaaagtcgaagataacttctgggacattggtcaaggcccatctggccccgattcagaaattttttatgatcgtggcgaagctttcaataatttagctgatgatgacccggaaaactatcctggtggtgaaaatgaacgttacttggaagtttggaacattgtcttttcgcaatttaaccacactcctgaaggtacttacgaaccactcccgcgtaagaatattgatacggggatggggctagaacgggtcgtttcggtctttcaaaatgcgaaaaccaattttgaaactgacctattcctcccaattattcataagacggaagaattaagtgatggcaagcactacggtgataacgcccaggacgatgtgtccttcaaagtgattgccgatcacgctcgggccattacgtttgctattagtgacggggccttaccttccaacgaaggtcgtggctatgtcattcggcggttgattcggcgggcaatcctacatggtcaaaaattaggtttgaaagaagctttcttggaccaattagtaccgattgttggcaagatcatggcttcacactatcccgacgtgctcaaaaatagtgcgtatatcgaaaagatcgtggcttcagaagaaagtcgcttcaatgagaccttgaatgatgggttgaatctgttaaataacttgatcgcggaaaccaagcaggctggtcacgatacactagctggtaaggatgcatttaagttatatgacacttatggcttcccgttcgaactaactaaggaatacgctggcgacgaagatttagatgtcgacgaagctggttttgaagttgaaatgaaggctcaacgtgaccgcgcacgcaatgcacgtagcagtgccaagtccatgggcgtccaacggagtctcttgatcgacatcaaaacgccaagtgaatacgtgggatatgacgaattaacgaatgtgcaggggactttgaacgacattattgttgacgagaccctggttgatcacgtcgacagtggtcaagctgagatgattttcagcaagacaccgttttatgctgaaatgggtggtcaggttgccgaccgtggtgtgatcttagatgatgccggtgaaatggtggctaaagtgactgacgtacaaaatgcacccaacaagcagcatttacacaccgttgaagtgttgaaaccaatgcgaaaagacgcgacttatacgctgaacgttgacttggcattccacaacaaagtcgaaaagaatcataccgccacccacttgttagaccaggcgcttcgtgacgttctcggtgaacatacgaaacaagctggttcacttgtagaacctgattatttacggtttgactttactcactttggtcaagtgactgacgaagagttagctaaagttgaacaaatcgtcaatgataagatctgggcagcgttaccagtcagtgctattcaaacggaccaagaaactggtcacaagatgggcgcaattgcggttttcactgaaaagtatggcaaaattgtgcgggttgtttcaattggtgattattctatcgaattcgatggtgggacccacgttaagaacagtagtgaattggggctatttaagattgtttccgaaacagggattggcgctggaacgcggcggattgaagccgttacttcgaaggaagctttcgaactgcttgccggcgaagaacaaaccttgaagcaagttgctgctcaagtcaaggcaccgaagttagctgatacgccagccaaggttagtcagttacaagccgatctcaaagcggaacaacagaaccgggccagcctcgaaagtcgcttagccaaacagcaggctggggcagtctttgatcaagttgacgatgtgaacggtacgacgttgatcgcccaacaaattgaagtctctggcatggatcaactccgtcaattggccgatacttggaagaccaagcagtattctgacgtactggtacttggaacagtcattggcgaaaaggtcaacttattagttgctgttagtgatgacaaggtcaaggcaggtatcaaagctggtgacttgatcaaagccattgcaccaaaagttggtggtggcggcggtggccgcccaaccttagcccaagctggcgggaagaagcctgctggactaccagcggcgctgaaagctgcgcatgagtggcttgccgaacaataagactgattgctttggttgcacatcctgttttttatgttggttagctatgttaaagctatcaaaataacaattaaatcagtgctgttaggacgagaccgttctaacggtactgattttttaatgttatggcaccttgtgaccggcttaactcgtagaagattgggttacaaagggtgtgcctgttttgaatttcaactattcgaacattcgaaacaggggtatgtcagcatatgaaaaaacagtgtaaatcgggatggatttgcagaaaacgtctgcattctccgggttattattacgaatgtgttacatcaaagtggattgattgtacttcatatgggcatttagtaaaatagattagaagcggaaactagcgggaggtgcttgatatgagttcattagacaaaacaatgtactttgacttcgataatgacagcgttaaggatgtccacgacacgttaacgacagtttatgaagcgttacaagaaaagggctacaatccgattaatcaaatcgtgggttacttactatccggtgatccggcgtatatcccgcgcttaaaggatgctcggaacttaattcggaagcatcagcgcgatgagattatcgaggaacttgtcaagtcttacttaaaggcagataaggatgttgatgcatgaagttgatggggttagatgtaggttccagaactgttggcgttgccattagtgatgcttttggatggacggcgcagggcgttgaaattattcgaatcaatgaggatgctgaggaattcggaatcgaccgggttgctgaactcgttgaagaattggatgctgggggctttgtcctagggctaccaaagaatatgaataataccttgggaccacgggctgaggcggcgcaacattacggcgagttactgacagcccggtttcatttgccggtagactttgaagatgaacgtctgacgaccgttgaagctgaacggatgttggttgaagaagctaacacctcacgtaagaaacgcaaaaaggtgatcgacaagctagctgcaagtttaatcttgcaaaactacttggatcgccacggcaaactcacacaagaatagcgaggaactaacatgagccaaaaccaagatcgtaaagacaatgatgtgatcacattagttgatgacgaaggtaacgaaaccttatttaatattttgttcacgtttgattcagaagatttcggtcactcctatattttattatatccagctgatgctgcggccgatgatgaagttgatattcaagcctacatctttaatcctgaagatggcgacaatggcgaattacaactgatcgagtcggacgacgaatgggatatggttgagcaagttttgaataccttcttagccgatgacggtggcatgcaatagtcgaaagtagattaagctcgtgggcgcatgtccgcgggcttttttagaaattatgagacggttctaactgtcgcataattgtgataaccatgctagaatattaattgttattgaaaggaagcgggatgttgatgactgctaacaagcgccgctttaaagcggaaattgatggtcgtacttacacgatcattggcacggcatctgaccgtcacatgcaaacggtgacgcggatgatgaatgagcaagtggcacaattaaaaaaattagcccccgatttgtctgatacggagattgcgacgttgctcgcattcaatgcgatttcagatcaggttgacaaacaagctgaattattgaaaatgcaaacggatgatgccgacaagtaattgcattgtccgtttttttgcggcttttcgtaattcattggaacttcggagggatatcagtgaattccaaagtattgaatacgttagagtaccaacaagtaaaacaacaattagcaccatacttagtctcggcaacgggccaacaagcactcaatgaactacacccaatgaccagcgttgcggatattcaacgggccttagatgaaaccaacgacggggcagaagtgtatcgtttaaagggtggcattccggtcgctcgtttagcggatataaaaccgcatatgaaacggttagctatcggtgcgaccctgaatgggagtgaactcgggcaagttgggcgggtgttacggacaacgcgcgcaatcacgcgcttttttgccgagttgctagaagatgcacctgagaatgatattcgacacctgtttgatgaagttgcagaattagttactttaccagatgtgacgaagcgcctcgctactgccattgaaggtgacggtcatatcacggatgaggcgtcaccagaactgagccggattcggagcaatatccgtcgtactgaaacggagattcgtaaccaaatgggtcattatacccgtggccatgatgccaagtatttaagcgacccaatcatcacgattagaaacgaccgttacgttatcccggtcaaggccgagaatcgcagtcggtttggtggcatcgtgcatgatcaatcagcgagtgggcagacgctctttatcgaaccccaggctgtcatggcgatgaatgaccggttacggcaaaatcaagttgcggaaaagcaagaagaacagcgtatcttggaggaactctccaacttgattgcgccttaccaggacgaaatcattaataatgcggcgattcttggacatttcgactttatcaatgccaaggcgcgttatgcgcatgatatgaaggcgactgaaccggccgtttcacccaaaaatgaagtctatctacggcaagcacgccaccccctgattgatcctcgcaaagtcgttgccaatgatattagtttaggtactgattatcaggcgatggtcattacggggcctaacactggtgggaagacgattacgttgaagacgctgggattactacaattgatggcccagtcaggattatttattcctgttgaagccggaagtcgcgttggcgtttataatgagatctttgcggatattggtgatgaacagtcgatcgaacagaatttaagtacgttctcatcccatatggaaaatattgaaagtttcttagcgcagatcgacgctcacagtttagtactcgttgatgaattgggtgccgggactgatccgcaagaaggtgcggcactggcaatcgcaattctggatgccattggggccaagggaacccaagtcgttgcgacgactcactacccagaacttaaggcgtatgggtttaaccgacctgatacgatcaatgctagtatggagtttgacgaagaaacactcaagccgacgtaccggctattggtcgggattcctggtcgaagtaatgcgctcgatatcgcacagcggttgggcatcccgcaagcgattgttgatcaagctcggtcgttgacggatacggatagtcaagacctcaacgcaatgattgcggatttggtgacgaagcgcaaacaggttgaagatgaacaactgcatctgaaaacccaagtggcagattctgaaaaattgcaccggcagttgaagagcgaattcaatgcgtatcaacagcgtaaagatcagttgatcgaagatgccaaagtgcaggcgaacaccattgttgagcaaagtaagactaaggccgatgctatcattagtgatttgcgtaagaaacaattagcgagtggtacggcgactgtcaaagaaaacgagttgattgatgcgaagggcgcgttgaatgcattggagcaacagcctaagctcaagaaaaaccgtgtattacggcgtgccaaagcccaacatgattttcatgaaggtgatgacgtgctggtcaaatcgtatggtcaacgtggtgtgttgatgcgtcagatgggtaaacacgagtgggaagtccaactcggcatcttgaagatgaagattagtgacggtgacttggaacgcgttaagccagaagagccaaaacgcgcgcgtgctactgttcagagtgcccacgcgagtcacgtttcgccgaacttggacctgcggggtgtgcgttatgaagacgcgatgactcaagttgatcgctatattgatgctgcgttgttggccgggtatccttccgtcacaatcgtacacgggaagggaactggtgctctacgagaaggcattaccaactatctcaagtctaatcggcaagtcaagtcgtttcactttgctgcgccaaatcatggcggcaatggtgcgactgaggtgcagttcaaataaccagtgacgagtgccaggtgcagatcagtgatgacgcgaattcatggctgtgcacgatatcggcgctttgattgcaggcaaattgtttgtgttccacccggttactggtatacttactattagtaacagataaagcttaaaggaggccgattataatggtcgcagcaactactgataaaacttttacaacggatacggcttcaggagtaacgttaactgacttctgggcgacatggtgtggtccttgccggatgcagtcaccagtggtcgaacaattagctgacgagatgggtgacaaggtgacgttcaataagatggatgtcgacgccaaccctgaaacggccagcaactttggtatcatgagcattccaaccttattagttaagaaggatggcgaagtggttgataccttagttggctaccattccaaggaacagatccaacaaactttagctcaatatctataataagctgggccattatttcattaatggttcgctagcgaacgcgccttcttaagtgaacggcgcgtttttttgcgctcttttttaagaccggggacaaccgttaataatgactatataaggaaaactatttaacgttgcaaaaaagggcgaccacgtggccgtcctttttactgtgcttcttcaggttgttcgtcatcaagttcaacttgaggccgcacgatttcgattggtgttgcgggatcgtgattgacgattggttgattgtgatcaatcgtaactgagatgcgcagtcgcatgcgattttggaacgtaattttagcttcactcacacagttggtgcggagcgccgactgctcagctagaaagccagtttcaagcataaagtctggtgatttgatcgtggcgctacgccgagcgaccggctcaccagtcaattcatacgtgattagatcatccgtcgttgtaatcacgacaaggtgaccccagccggtttgctcaaaaaaggtaacaagatcatcatcactagcgacaggaaactggcgtgccaagtctttacccgcccagtaaaggatgccactactgtcatcacccaataactttggtattaaggcatctcgcaagatttccacactgaggatggaagctttgatcgagttgcccgcaaattgagaataaaagtcgttcgtcatgataattcctttccatgcaaaaaatcgtggtactctagccactgtataatcattattataccccgtttccactaatgtgtcggtttttttcaatttatcaacggaaactttacaatttcgtcgcaattggtctggcttgaaatcaatttcaaaaaagaccataataaagtttcagaattcagtgaacggagattttaaaatggcaaatgaacatgcaattggcttcatggattcgggggttggcgggttgactgtcgtcaagcaagctttgaaacaactcccgcgcgaaacagtttattttattggtgatcaggcgcgtttgccatacggtccgcgaccagctgaacaagtgcgaactttttcttttcagatggcggatttcttaatggcaaagcagatcaaaatgctcgtgatagcttgtaatactgcgaccgcagcggcattgccggcgttgcggcagcagttgtcaattcccgttattggggtgattgcgcctggttcgcgggctgcgttaaaagcttctcatcgtaatcgaatcggtgtgattgcgactgaggggacgattcgtagtaatgcttatcgagatgctatcttaaccaaagatcctactgcgacggtcgtttcgcaggcgtgcccaaagtttgtgccgttggttgaatcgaatgagtatcaatcaacggttgccaagcgggtggttgcggaaacgttgaaacaactaaaaaaacaagacgttgatacgcttgttttgggctgcacacactatccattattgcggccacttattcaaaatgtgatggggcctggggtgaccttgattgattctggtgccgaaacggtgaacgatgtctcggcggtactcgattacttggatattgctaacgatcgttctactaagcgttatccggatgagtactacacgacgggggcggctgatcaattcgaagcaatcgcgcggaactggttgggccaaccggactttcacgcacaacatattgatttagggagtgaagcgaatgactaaaccacaaacattgatcattgcgactaacaatgccaataaggcgcgcgagtttagcgcgatgttggcaccgtatgatattaccatcaaaacgttggctgattttccaaatattcctgaaattaaggagaacggtatcacgtttgaagaaaatgccactaaaaaggcgacggttgtggtcgaagcaaccggattaccggcaattgcggatgattccggcttgatggtcaaggcgttgcacggtgatccgggagtgttttcggcacggtatgctggtgatcatgatgatgctgcgaataatgccaagttgttagccaaccttggtggcgttcctgaagcggagcggaccgcgacttttcatacgaccctggttgcccttaaacccagtggtgagaaacttgtcgttaacggtgagttagccggccgtattctgattgccccccgtggtgacaatgggtttggttatgatccgttattttggtcaagtaagtttcaaaaatccttggcggaattgacgccagcacaaaaaaatcaaatcagtcatcggggtgcagccttgcgacaactgatgactaaattcgatgaatggtgggcgaaagcatgaaatgtttagtagtgagtgatagccatggcgatcgtgacgtgttagttcgattgcttgataagtaccgcggtcaggttgacgccttttttcactgtggtgattctgaattaccgcatgatgacgcggtttttcaagagatattcacggttcaaggaaatatggatttcgatgacgtgattccaaatgaagtgaatccaactattgatgaggtgacagtctacatgacgcacggtcacttagtcggtgtgaacatgggattggaccatctattagctaatgctgaggtgcacaatgcgacgctggctttctttggtcacacgcatcaactgggtgttgaacgacgaggcggcgtggtcgtgcttaatcctggtagtattacttatccgcgtggtgaatttgcacgtatcggtggcacctacgccatcgtgacaacgtcagccgcaggtatcgacgtccaatattatgatcggcaactacaagcggtgccagaactaaaatttcattttgctgattaaaatgtggtaaaaaaactgatttttagggctgtgcaaagtgcttttgcggttaaaataaagggatgggcttagtgaaggaggcgctgtatgttaattcaaccagttgaggacttattgtcacgtaacgccgaccattatttgattccggcggacgtggttgccaacgttcaaactgataataatttgtatcacgcgtttttagttctaacgaaggtcaagtattccaaaattccagtacttgatcatggtggtcactttgaaggtttagtatcgttgccactgattactgaacaaatgttaggttttgatcaactgaatactgaaatattactgcaaaaacgtgtctgtgacgtaatggagacacaagttaagacggttcatgatgtggatgacgttgaagagacgttacacttgatgattgataatccgtttgttccagtcgttgatgaacagcaaatttttcaaggaattgtcactcgtcgtgaattcatgaagagttttaactttctgacccatgaaatcggcaaacaatatgatatgattgagaaggatttttccactagtgaaaaagctaaataaatttttggagggtctccgatggcaaaattagatgcacaatcaattattaactacattggcagtgcgaaaaagaaaacacccgtaaaagtatacgtgaagggtgctttagaccaattaaacgttccagcaggcatcaaaactttcttcagtggcaacgctggggtattatttggtgactgggcggatgttgaaccgttcttaaaggctaacgctgcaaatatcgaagattatgaattagaaaatgacgcgcgcaattcagccgtaccaatggcagatttgaagcaatacaatgcgcggatcgaacccggtgcgattattcgtgaccaagtattgattggtgataatgccgttatcatgatgggtgcggtgatcaacattggtgccgaaatcggtgaaggctcgatgattgacatgggtgccattcttggtggtcgcgcaattgttggtaagaactgtcatattggcgctggtactgtgttagctggcgtggtagagccaccttcggctaaaccagttcaaatcgatgacgacgtgctgatcggtgccaatgcggccgtacttgaaggcgtgcatgttggtaagggtgccgttgtggctgcgggtgcgatcgtcattgaagacgtcgctcctaacaccgtagtcggtggggttcctgctcgtaagttgaaagatattgatgataagactaagagcaagactgaattaatggcagaattacggaatctttaatggtggagggataaacaatggtcttacgggaaaccgatctaattccaatttatcaacacttacaccaaattccggaaatcggcttacaagaacatgaaacacaggcttatttattgtcgattattggtaagatgcctcaagagtggctgacaatcaaaaccattcctactttggatacggcgattttagtgaaagtcagtggtttaaagcatgattatcgaatcggttatcgaactgacatcgatgcgttaccagttactgaaaatacgggcttaccatttgcatcgacccatccaggtgtcatgcacgcgtgtggccatgatattcatatgtcagtcgcgctaggaatcctaagctactttgcagagaaccgacctgcgaccgacatggttttcatgttccagccggctgaggaaaatgcctcgggtgggcaacgcttgtacgaaagtggtgcgctagatggtgattggatgccagatgagatttttgcattccatgacaatcctaatttaccaactggagcgatcggttgccggatgggcacgttatttgcggggacttgtgagatccacgcacacttaagtggtaaaagtggacacgcggcttacccacatcaagcaaacgacatggtcgtcgctggtgcggcgttagtctcccagctgcagacgattgtagcgcgcaacgtggacccgattcaaagtggtgtggtgacattaggtcactttactgctggcacgattggcaatgtgattgccggtgaggcccagattgacgggacgatccgagcgttgacgcaggagatgaacatgcatattcagcggcgggttcggacgattactgaggggattgcgctcgcctatgactgcaatatcgatttgaagctcaatcaaggtggttattatcccgttgagaacaatgacgcaatcactgctgattttatcaagtacatgcaggatgatgatgatgtcaactttattgaaacggaaccagcaatgactggggaagactttggttatttgattcatcagattccagggacaatgttctggttaggggtcgacagtccatattcgttgcactcggaaaacatggtgccgcacacggctgccattatgagtggggtcaatgcgatgaccggctttttgactcatcggaatgcgttacacaaataaattacaaaacgtactgcgctaacacgtgtcagtacgtttttgagtttcaagaatgcagagcgttgctgcaattaatggttggttgtgaccgcacaataattttcgcctggtcacgttaggttgcgaatgggaataactaaaactattcctgacaataacaacgtgcgtcatggttcccacctgaagaaatttgtcagatgaaagatcaagcccgcaccgtggcgctcatttctgagcaaccgctgtgcgggcttgtgttggttgagcttacttgtgcgttggggcgatatttaaacgtggcgaggggagttgaattcccgctgctcgggccgcgttcaagtaggcggccaaaaagtcgcgctgaattgcgaactgcatgccatttttgacgtaaaattgtactcggaagaccaacgtcccatcggcttgtgtcgtgacgccttgaatgtcgggctcaccgatgatatcaggatactgaggcacgaggtcggcattagtttcgcggaccacgttagtcagatcttgaacgggagtcgttgtgagaatgtagaggtcaatcagcacgcgcatatcgttacgcgactggttgctaatgattaaaatcttgcgattgggaataaagttcaacgtgccatcgggactcgtaacttgagttgtccgtaaaccgattgcggagacggtcccctcaatggtttcgattttgacgtaatccccaacatcaatctgatcttcaagtagaatgaagaacccggtgacaatgtcactgacgaagccttgggcgcctaaacctaacgccacactgaaaatcccagcactagcaatcaacgtccccacgggaacacctaacactgaaagtaccgcatagatgccaaaaaacatgatgacgtaatggtagatatttaatgataatgtaaaaatcgttgaaatccgattattggcagtatcactggtattagcattcgttaaaaataagtggtggatcaggcgttttcctagccgatcaatcacccaaaatagtaaaataaataaaatgatttcgagtagcttgccgccaatattaataataatttgttgccagtcaattttcttagccaacttcatccacaccgaaacttgtttagtcggtgtgtcaaccgctgctaggttaattgaattaaacatatcttcaccctcgttattgttgtctgttcactagtttatcagatttgacgcgggcaaccaagccgtgatcaagttattgcgaccaaatgtgactgggtgaatgttgtaagcacttttttaattgcggtatactaaagacaatgctatgctagttttaatatcatggctgttgaaggaggaattttaggatgattacacacattgcgggcatcattgccgccattgcgttcttattattagtatgctttatcgggatttttttaatgcggattactaaaacgatgggggaagtcaaccgtagtttaaataatattacggatgatgttgacgccttgtcacatgagactgaaaaaatcatggcaaatgccaatgaactcttaaaggatgttaacggcaaagttgcaacaattgatccagcgtttcaagcgatgggcgacttaggtcagagcgtctctgacttaaatgctgcgactcgagacttaacagccaagattggcaagaacaatgagaagcggagcaagttctccagcgcaagcaaggtcggcaaagccgcttttgatgtctatcgtaatcgacgttcaaaaaataatagtgaggagtcttaattatgtcgaaaaagggattcttattaggtgttgttttaggtggtgcagcgattgctaccgccgttatgaagatggatgatgataaaaaggctgaattgaaagctaaagcacagcaaggaattgccgattttaaggatcgggcaatcgactatgcgttctatgccaacgatgctgctgaagacttcaaggctgaagctgggcaacaatttgaagatacaaagcgaaaagtggccgattttgctgaccagtatcaagccgctaagcaggaaacgggtgaaagctttggctcaagtcttgaccaagctacggatagtttacggtctgaattagctaaggtcgaagatgatgaaggtgatgatgaagatatcgtcattgatggtggagctgcttatcaaaaagctggcgaggacgagaagacttcagcgcccgtaccagaatcagcacctgctaaggacgcaacacctgcgaagtctgatgatgaatcgacaacggatgaatcgtcaccagccaagtaagctgacagcgataagataggacactgagcaagtgctcggtgtcctatctgcttttgaggaggaatcacattgtattcaatcggagcggtcgccaaaaagaccggtatttcaagttatacactgcgctattatgataaggcgggcttaacgccctttgtgaagcgtgataagcagggccgccgggtcttcaatgatgaagacttggattcactggcattgattcgttgtcttaagcagaccgggatgccgttagaggatattcgacaatttattagttggtgtgccgatggggatggaacgattgatcaacggctagcaatgtttgaagagcaacgccaggctgttgaagcgcaaatccatcaatccttgttgaatttgcaaaaagtcaatcataagattgatgtttatcggcgtgcgagtcaggcggggagtgaagccgcggttgactgtgacgtgctgccactgaaaacgacggcggcgctgttagccgaagtggctgattatgaaaccgaacatccgctaccggaataacactaaaagcaagtaccagtcaacgctaggtaaaaaaagagggccgtcacggattatgtcgtgacggccttctttgacgtttttaattaaagatctaatacttttaattcttttggcgtatgggtaaatggcttaaagccttccttagtaacgaccccacagtcttcgattcgaacaccagctacgccgggaatgtagatcccaggttctactgagaagcacatgccttcaacgagtggcatgtggttaccagccataatcgaaggaaattcgtggtcagtttggccgattccgtgacctaaccggtgaatgaagtattcgccatagcccgctttggtgatgatatcgcgtgcgattttatcgacatcttcggctgccatgcctggtttaatggctgcctgagcagtcaagttggcttccagacagacgtcaaagatttccttttgcttggcactcggttggccataagcaattgtccgggaagcatcagaagcatagccttcatacatgacgccgaggtcgaatagcactaattcatttggcttgacttgggtttcgttagttgcaccatgggggttggcggcatgttcaccagcttggactaaagtgtcgaaactcatttccataattccctttttcattaaggcatactgtaattcggcagcaatctgttgttcggtgcgacccgccttgacagcagcaaatccttgttcaaaagcaaagtcggcccatttaccggcaatgtttagtttttcaagttcatcagctgttttgaccagccgtaattgctgaatataaggtgatagatccttatcgaagtgggcagctggaaattgctgtttgagcgcggtaaagcggtctaacgtcaagttcccagtttcaagggcccaaactttaggatcagtcaattgtgcgtgaatgtgatcagcaattagcgcgtatggatcttcatggtcgaggtagccgaaaactttgtaaggccagcccatctccttgattgcttcaacttcgagagcgggtgcaaagagaaatggttccgcatccgcgaaaacaaacagtgctagcgtccgttcgtaggggttgctctcaaaaccagtcaaatatgaaattgtgtgaaagttactgatgtaggtcacgtcaacgtgattgtcttgggtccattgacggacttgttgcagtttcgtataatctgtcaattcaaacactccttagataaaataatagataataatactagtatagcgctgttgatgataaaaagctgagaataatgagcccaaaataacaatcttcgtgtggtaaatcttgcattttgaaaacaagtacggtattattttcatgaaagcgatttcaataacaatcttaagttgcattggaagcgtaattttgctatattggttgatgttgcatgaaaacggatgaaaacatatgataccaagcaagaaagggctatttttatatggaaaaacaaacagtaacaatttatgatgtggcacgcgaagcggcggtttcaatggccacagtttcacgagtcgtcaatggtaatcccaacgttaaacccgcaacgcgtaaaaaggtactagctgtcatcgaacggttagattaccggcctaacgcagttgcacgagggttagcaagtaagcgttcaactacggtcggggtaatcatcccggacgtgaccaacatttattttgcggcgttagcacgcgggattgatgatattgcgatgatgtacaagtacaatatcattttaacgaactccgatgatgcgggtgaacaagaagtcaacgtgttgaatacgttgatggctaagcaagttgacggggtcatctttatgggtaaccatattgatgacaagctccgggctgaattcaaacgggccaaggcaccagttgttttagctgggacggttgatccgaacaatgaaacgccaagcgttaatatcgactacgctgcagctgttgaagaagtggtcactaacttaattgcacgtggtcacaagaagatcgcgttggctttaggctcattgtcacaatcaatcaacgctgaataccgactgacgggttacaaacgggccttaaccaaggctaagattccgtttgacgacgccctcgtttatgaagcgggctactcatatgatgctgggcggaagttacaaccagtcattgcggatagtggcgctactgcggtattcgttggggacgacgaaatggcggctggtcttatcaacgcaagtatggaatccgggatcaacgttccagatgacttggaagttgtgacgagtaatgatacgattattacccaaatcacgcgtccagccattacctcgattacccaaccattatatgatattggtgcggttgccatgcggatgttaactaagttgatgaacgataaagaacttgacgagaagacggtcaccttgccatacggcattgttcggcggggctcaaccaagtctgctgattaagttcggttgtctgccagctagtgacgttggcataatttagaacgatagcgttatactaggtttggaatatttattccaagccttttttggttttggaatgcgtgaaaggatgagttaaacggatgacacaactaataatgcggccacggcccggaaaaattaagttaggcttgaaggcgtcccaagcacccgcacaattaatggatcgtttgcaataccggcccgaagtatttgaattttttacgagtgccacggactttgaaccggaagcatttcagacacttaaaacagctgtccaatttgtaaagacaactgtcaccgagcaaattgtgattcatcaccctatgagttatcaaggcgttcatcttgatcaattgcttgatccacatcgtgaagctgcggcgtaccaattcctacaaacgagtacggcccagttacttgcgttggcgacggaattggatgtcaaggtgctcgtacacggtggctatggtagcgacagtgggcgcttgatcgatgagtatgagtccttgcaggttgcacgtgacgtggtctttgagcggttggataatttggttcgtcaggcgagtggacatgtcgtgattgaaaatggggtaacggcaagttttatgtatggtgatccccagttagatgagcgtatcattcagcatcattatccgctggtttgtgatttgagccacgtcttcattgcgctgcacggtgatatggaattgaccatgttggctttgaagcggctggctccactcattcaacattatcatttggttgattcgatggggacgcggcacgatagtttacctttagggcagggactgattgactggcagcgggtgttaccagtcctcaacccgcacgctaccatgatttatgaagtgccggatgaaacggatgcgacctgcgctaacatgttgagtagctatcactatctacgcgcactcgaactgcggtcgatcgagggaggacaagcgaatgactaacttagtagtccatgtcgacgagccggctaaggtcgcaacggccataagcaatgtgcagaattttttggcagcccggccaactagtacggtggtggttgtggtcaacgggcccgctatcacgacgctggtaactggtgcctggaagccattacaacagacgttaccgcaagttgagattgatgcttgccataatgccatggtgagtcatcaaatgactgcggcccaacttcctgccagtgtgacggtcgttcccgctggtgtggtgcgaatcgtggacttgcaagctgtgggttacgcatatttacggccataacaccagtttgtcgtggttgtggttgtcattagcaaactgaaatttcaaatttgaaagagagtccaataacgaaactggttcattagatttgcaataaaaatcgcagaacttggacgcccttggttctagtgcttgaaatcgctcgctttttttgctatcatactttacgtatgtttatctactaaactgaaaataaatatgaaagaaggagtcacacatgtcaggacattcaaaatggcataacattcaaggacgtaagaacgcccaagatgctaaacgtgggaaagtctttcaaaagatttcccgtgaactttatatggctgtaaaagccgggggtcctgatccagattctaacgcgcaattgcggttagttatggataaggccaaagctgccaacatgcctaaagacaatattaaacgggcggttgataaaggtagtggctccggtgcggagaactacgaagaagttacttacgaaggctacggccctggtggtatcgccgttctggttcacgcattaactgataacaaaaaccggactgctgcggcggttcgttcagcgttcacgcatcatggtggggctttagccgcaactggtgcggttagttacatgtttgatcgtaagggttacatcgtgatcagtcgcgaagatttagataccgacgaagatacgatgttgatggacgttttagatgctggtggcgacgatttacaatcaagcgacgaagcgtttgaaatttacactgatcctaaacaattagctgccgttcgtgatgccctcgaagctaatggttacaagttggaaacagctgaattaaccatgattcctgaaaacctaacggacgttcctgctgataaagtggaaaagttacaacacatgattgatgaattggaagataacgacgacgtatcagaagtatacgaagctgctaactacccagattaatgatgaaaagacgtggttctttgatgataaatcaagaaccacgttttttattgcttaaaatattagtaaaacaagtgcgtcgaacaggccagtttgctaaaattagagcagttgaatactgaagggacgaataatcatgaataaagtaaccgtactaggtagtttgaatgttgattcgattttgcgtttcaagcgttttcctaagcctggtgaaacgctaccgctgactggtaagagtgtcgctggtgggggtaaaggggctaaccaagccatcgcagccgcgcgcgctggtgcccaaacgacttttatcggtaaagttggtactgatcaggaaggggcctttatggtgcagcagttgacgaatagtggtgttaatgaccaatatgttcaacatagcaatgtggctagtaccggctcagctttcatcttgttagatagtagtagtgagaaccgtatcttaatcgatggtggaactaatcagcaggttacggccgaagatgtcgaacgggcccaacccgcaattagcgctagtacttttttgattgcacagtttgaaacgccgattgcagcaacgattcgagggtttgaattggctcaggccgctgggcaaaaaacgattttaaacccggcaccagctacgacgacggtgcccgcagaattactagcgacgaccgacttaattgttcctaacgaaactgagacggaaaccttgactggtgtgcacattactgatgagcaatcgatgattcagggcgcacagaagttgcaggcgctgggcgttgctaacgtgatcattaccgttgggagtaaaggcgctttctggatgcgcggtgctgagcacggcttcgtcccagcttataaggttgaggccgttgacacgactgcagctggggacacctttattggtgcactcagttcggtcttaatgccagactttagtaatttggccgctgcggtacggtttgccaaccgggcatcttcgatagctgttcaaaaattgggtgcgcaaccatcgattccaactaaggaagccattgaagcggctgagcgggcctaacgccttaattggtttatatcggggcgcttataacgccgtatgttaggattgcaaatgaaaatatgcgatgacgagctgttctggaaataatttgttatttctggaacagcttttttgatgccaaaataaatgtcatttttttcgtggaaagtggtcgttgttacgaaactaatgattgaaaggagcgtgaccatgataaatggtgattgaagcagagttgaacgaaatcattcaggcagccgtgaatcagcgggccagtgatatttattggttacccacggcagaagggtatcaggtgttagtgcaagcagcaggcagtttgcgggcacttactcagattacaactgagttggcccagcaattgatgaatcacatcaaataccgtagtaacatggcgattagtgatcatcggcggccccaattaggggcgatgacgttaacattggcagagcaaactttaaatttgcgaatctcggcagttggcgactttttggaccgtgagtcgttggttgtccggttattgtatgaaggtccggcccgaaaattgagctatttggtcccacagcaacggcaacaattgagtcaattaatgcgacgaacgggattgatcttattttccgggccgatgggttctggcaaaacttccacgatgtatgatcttgtgcggcagcttcgtggccaacggctagtcatgacgatcgaagatccggttgaaatttatgaaccacaatttttacaactacaagtaaacgcaccggcccagatggcgtatggcgatttactgaaggttgggttacgccaccatcccgacgtctttattattggtgagattcgtgatgccgaaacggctcggattgcggtacaggcagcgctaagtggtcacttagttttaagtactattcatgcgcgcggtgtctacgggattattccccggttgacgcaattgggagtggaagccgctgttttggagcaggctttaactgcaatgtcctatcagcgcctcgtaccagtgacgaatggcagcgtggcgacgattttcgatacggtcgtgttaccgcatgcaatgcccaaaacgtcgcaaatgatgactgaaaggtgggcggagttaattgatgaacaattggcagcgggccgtctcgatcatgcgacggccaatcaacttaaggaagcgtaaacggcttccgattgctatgcaggcgaagctgtttgaaacgctagccgacttgctaggcaacggcttctcgtttcagcaagcctttcaatttacattggatgtagaaggaccggcctttcaatccttgcagcccgcgctggggcgtttagccgcgggtgatgatttgtctatggcgctgcgtccatacattgcggtggacttgtattaccagttcttaattgctgagactcatggtgaattacgccggaccttgatgcaggcaggtcaattaatgcgagcgcgtgctgaacagggacgccaaattcggcggttgttacagtacccttgtctgctgttaattctactgctgggaactttaggcacggtcaaagctgcgattttaccgagtcttgctcatggtggtaatggtagtgggacaatcgcgaattggcaatggtttagcggtatcacggtcattaccttggtgatttgcttattgctggttggccttcaagttagccgattacccattcggcggcgctatcagtggttggctcaagtccccttgattggtcccctgatcagaaactactgtggttactatttaagccttaatgcgggtatgctgctgactggtggtttagggattcgtggcatttgtgaagtcagtcagcactttcaaactaaggcgctgatttatcagcaagggcaggttatcgaacaggcgttactgactgggacttcgttagtcacaattatccaggaggaccgattattacctgatgagttagcactactggtcggcaaagagagtccggcagaacagttaagtcaggaattactatactttgcaactttgcagtacgaacgcttgattcgacagttgaaccggatgattggttggattcaacccatcatgtttggcattattgcactcgtcgttgtcggcacatacttgagtttgttattaccgatgtatcaatcaatgggggagattttaaaatgacattattaatgaaacgcttgatgaaaaaaacggcagcaccacagcgcggttttaccttaattgaaatggtgatcgtattggcgatcatcagtctcttgatgttgatcgtggtgcccaatttgaatcaacaacgtaaacaggcggctggtcgccaacaagaagccctgactgaagttgttcaaaatcaggctgaaatgtatgcgaatgatacgggtaagaccgtcacggatgacgacgcaatgttagaagaagttcggaacaagggatatattaacgatggtcaatataagcaggctaagtcacagggcattagtccggtacggccgcaaccacaaaaagtagttggtggttaagcgacagggatttaccttaatcgaaacggtagcggtcttggcgatcgtggctagtgtggcggtgattgctgtgcaccgttttcccacacggcaacgccaacagaatgcggaacaggctttctggcgggagttacaaacgatgtggcagcaacagaccttaaccgctagtgtgacgggtcagccccaggtcgtgagctttcgtggcacagaagtcgtgacttggggtggcaagcgggggcggcctatcagtggcccacagtggcatctcccactgcctgcaacattaaaaacagagcgcggtcgtgatattcaaatccagaaaaatgggcatccacagctagcagtggttattttcaagtcgcaattacagccgaagcagaaaatcaaactgaatgctttgatggggtggggggcctataaagtcacacatgttaaagacgcgaatgggttttttgatgattgaaacgattaccgctctggggctattgatgggtggtttgattgggtttgaaagtttagagattatgatgcagtcacatgaacgccagaccttgcaggcgattcagacggccagaaaacaatatgaagaccggcaacgtcagcagctattatccaggatacaggagcaagcacatgattaggcggcgcggttttacgttaattgaagccgttgtgtcgttagcaatcgtggccgtagtgctgacgacactttttcaggggcagcgcaatttggcccggcgcacccaagtggatttgccaacagtggattggtatttgatgcttcacgagcttgaaaatccagatcaccattttgtggtggaccatatttccgatgagggtggtctgacgccgggaaaagccgttcatttggttaatacggtcaccggcaaacagtatttattgacttattatcatatcctacatcgaatcggattgcgccactatggtggtggtgaaatcaatctgatgcagggcgttcggcaatttcacgtggccgatgatttgaccctgacgatgacgactgataaggggattcattttcaagcccaattactgttaccagatcggaggacaatggtagatgaggaagcgacgcggaacgatcctgctttcggtgattagcttattgttaattggtggggcgtttgaaacccaacgatacgttaattttcagtctcgccagacgttatatcgcttaattttacaatcctatgagcacccttatcagcataattcgctcccttgattggtgagtgaaccccgtgacttgaacttaacgcgtaaaatcagtaatatggttaaggattacagattttgcgggagggtgagtattctggcacaagcagaaaccgagacgctttttcaggtcttagatcaatcagttcaagttttgatgcaacaactatccgtttcttacgtggatgcgctcattgagactggcgataatttattaagccaatctgtacatgttgaggatggcaagccaaatccggaacagacggcagctttaacaaagctctatcaaacgatcgacttaaaacaattggacgccgaaacaattcggcgtgcgcttcagttggccttactaaaggcgattcataatgatcacgttgatccaaaccatcaaatgacaccagattcgattggactgttaacggcatacttgattgctaagttagttggatcgacgactgatttgtcaattttggatattgctgtcgggactggtaacttattaactacggtcataaatcagttgcagacggaccggccacgtccgattcagggttacggagtcgataatgatgataatcagttggcaatcgccgcgatgagcatggatctccaacgatcagcagtggagttgtttcatcaagacgcaattgattccctggtcatgccgaaaacgaccgttgtaattggtgatttgccagtggggtactacccattggatgaccgtgtccaaggttttcaaacgaaagcgacgaatggtcattcttacattcatcatttgatgatggagcaagcgatggctcatttgttaccgggcggctggggtgttttccttgttccaacgacgatttttcagtcgcaagagtctcaaggactgttaaaatggatgagcactgcggcttacctccaaggtctgttgaacttgccgactaacctttttcttgatgaaaaatcacgaaaatcaattgttgttttacagaaacatggacaacgagcccaccaagcaggtaaagtattactaggcgactttccatcatttgaggatcaacgtgcctttcaagcgtttaccgctcaaattgatgcgtgggtcgaccagaatattattcgctaggagtgtgtcgtttggggaagaccattgccatcaacgctggtagttcgacgttgaaatttaagttatttgaaatgccacaggaacgggtgattgcacagggcgctgttgaacgaattggattcaaaacttcaccggtcaatattcgctatggcgttgatcatcattaccaagagaaagccgtagtcgcggaccatttggctgccgtgaatatcgttttggatgagttaattaaattgcgaattattgactcatatgatgaaattactggggtcggtcaccgggtcgttgctggtggcgagcaattccatgattcagttttaatcactgaccaagtgcttaagcagattacggatctggccgaatatgcgccattgcataatccggctaatgcggtcggtattcgtgctttcaagcgggtactaccacatgtgcccgcggtcgctgtctttgatacggcgtttcatgcaagtatgccggcggttaactatctatactcgttaccgtatgattactatcaacgatatggtgctcgcaagtttggcgctcatggaacgagccatcgctacgtcgcggtgcgagcagctaaattattgggccgaccgctcgaaacgttgaagctgattacgttgcatttaggtgcgggaagttcgattacggcgattgatcatggacagtcactagatacctcgatgggatttacgccgttagctggtattacaatggcaacgcgctcgggcgatgtggatccgtcgctggttgcttatctcatgaaaaagcttaatattagcgatcctgatgaaatattaacgattttgaatacgcagtcaggcttactggggctagctggttctgcagatatgcaggagctcgaggcacgttatgatgaggactcacaggctcagttagctattgatatttttgtcaatcggatcgttaagtatgtcggtgcttatttggctgagctacaaggtgcggatgcattagtgataacggctggtatcggtgaacgggatgcacggatgcgacaacgaatcgcggatcggttgacctactttggcgtcgcgattgacccgactaagaatcaagtcagtggtgtcgaacgggacctgagtacgaccgatgcgaagattcggacgttactcattcctactgatgaagaacttatgattgcccgcgatgttgagcgcgtggctcagaatcagtgatcagcatcgtttcaatatgattaaggttgtaaagaggcacgcggatgaaaatccgggtgcttttttagatgctgaagtgaaagttattcatgttagtatgcgttgccttcactttattcacgtagcgggagcgttcactggtttagtcaactaacaaagctgaatcccagccatgcaagttagcaaacgcttacgcgtacataagatgaatttcgctagcaagcaatggtatagtccaatcatgtgattttcttaagcgtggccttttgaatgctaggaatttggccgctataataatttcaaggggagtgcaaagataatgacgaaagaaaattcacagcctgcgacggaacaactctcgcgaggcttaaaaagccgccatgttcaattaattgccatcggcggcacgattgggaccggactgttcttaggggccggtcaatctatccacttggcggggccagcgatcctgatcgcatacttagtgaccggtttagtgtgctttttattaatgcgggcgttaggtgaactactgttatctgaccttcatacgcattcttatattgattttattaagcaatacttaggtgataagaccggctttgtggctggatggacgtattgggtttgctggatcacgattgcgatggccgaaattacggctgctggtgagtatatgcagttttggtggcctaggttaccgcaatggcttccggggctgattatcttgattttattgctgggcttgaattctattaatgtctcagcgttcggtgaaactgaattttggtttgcgattattaagatcgctgctatcttggcattaattgctgttgggattggcatggtcttgtttagcgttaagacccctgtgggccacgccagcttaaccaatttggttagttatggcggttttatgccacacggaatcaaaggcttagtgctttccttccagatggtcctgttcagttttattgggatcgagatggtcggcatgacagcttctgagacggctgatccgaagacggtgattcccaaagcaatcaatgatattcccgtgcggatcattctgttttatgttgggtcactattctttctaatgtgtatgtacccgtggcaatacttttcagcggcacacagcccgttcgtacaagtattcaccaatttgggaattcgttcagcggctgcgattatcaacttcgtagtgctcacggcggccgcttctagttgtaatagtgcgttattcagtaccgggcggatgttattctcactaacgtatgatggcaaaagcaagtttgccaaacgaatggggacactatcgacccgccaagttccccgcaatgcgttatggttctcgactctggtgattgggttgtcagtaattctaaacttactgatgcctgggaaagtcttctcgctgattgcgagtgtatcgactacttgttttatctttatttggggcgcaatcgtcgtcgcacatatcaagtatcgacgtcaagcgggcagtcaggctaaagtgaaattccggatgccactgtttccgttatctgattacttcattctagtgttcttagcttttatcgctgttgttctctgtctgaagtttgaaacgttaatcgcgttactcgtgtcagcggtctgggtggttggcttatacattgtcaagatcgttagtgaccgaattcgtcaacggacacacgactagtcagcaataaccaggagtgctgattggctatcaagtaggttaactaatgggatttatgaagtgcacttaactctgccgattgcagttaagtgcactttttgacgatattagctagatttgtgaatatgggttggtcataaaacatggttccagtgctgacaaagcaataaacttaaaactgttctagtgtcttttagaacggtgcgcggtacaatgataaatgactaacgcgttgtgtcaggtgttctttaaaatggttcatgattaatacgtgctgttcagtaagtgccaaaactgtcagctttgactcggtggaaacggtttgtttagtataaacttgccgagttagtgtgccatatgatgactgacagtcgtaataggattcgaatgactgacatgggtacatgctgacgaacggataagtcagcttttcaagcaaaagtcatgaaattcgctagacatgacacatccgattgatgttacaaatgtaaatatacgaataagaggtttgaacgatgcaatattttacgtccgacacacatttttatcatgctgatttgttgggggacaacgactttgcgccccggctatttccagatgtagagacaatgaaccaagcgattgttgaccattggaatgcccgtgtgacggatcaggatacagtctatcatttaggcgatgttgcgctgtattttacgcgaccagcgaaattgtcttatgagcgggtttttgcactcttagcacagttaaatggcaaaatcatttttataaagggaaaccatgattcacgggccttctttaagtatttggctgctcatgatccacagttgaatggtcaaccgaagtttgaatttcacgacgtgggggtactgattaagtacgaccaccgccaatactatatgacgcactacccaatgatgatggggatcgtcaaacaaattatcaatttgcacgggcatattcatcattatgccgtcaacgtcaaggagaacatcaacgtgggtgtcgatacaccagaagtcgattacttggaccatccggtgccctttggaacgccattttcactggccgagatcgagcagatggttgacggtaaagccattgattttgccaagcgccagtaagcgagtgcttgaccgactttggtgaatgctttaggattaacaaagacaacgattgaggggcgattgaccgtggacgagcaagtcacgattctgcataccaatgatattcattcgcattttgaaaactggccacgtattcaacggtatttattaaccgaacgtgagcagcgccggcaatctggaagccatgtgatcacggttgacctcggcgacgcggttgatcgtgcccatccactctcagaagccactcaagggcaggccaacgtggcgttattgaacgcgattggctatgatgcggttacgattggcaataatgaaggactgggtttaacgcacgcggccttaaaccggttgtatgaccgcgccaactttgatgttgttctcggtaatttgacagatactgcaacgcaacgaccgccgcagtgggcattaccagctaaaatcattacaactgcacgggggacacgagtcttgttgctggcatttacggcaccgtttacgttgacttacccgttgaacggttggacgccggccagtgttaagacgcgattcccagagttgttacgacaatatgcagggcaatatgatgtcttaatcgtgatgtcccaccttggtatcaatgtcgatcggtggttagcaaaacagtttccggtgatcgatgttgttattggcagtcatacgcatcatttactggtgaacggtgaactgaaaaatggggtcctgatagcggcagctggaaaatacggtgagtatattgggcgaattgaactgacgattgatcatcaacatcacgttaaagcggccgcggcgcataccgttgccacggccagcttaccaattgtggccggtgatgaaacgttgattactggctgggagcaacagggtgaaacgttactcacgcggcaagttgttgcgaaggtgccgacgcagctgcggccacattggcaccatgcaagtgatttgacggccctcgggctagcggccattacggactatgccaaaactgatctaggtatgttgaacggtggcctgttcatgcgggatcttcccgcaggcatggtcaaccgaaatgatttacataccatgctacctcacgcgatgcatgttattcgagtgacgttaagtggtgaagcattgtggcgcttagtctatgagatggagttagttcgcccgtttttgaacaaatttccgattaaaggaatgggatttcgtggtcaagtctttggttatatccagtaccagggcctcacgtggaaaacgggacagcatacattactagtgaatggtcagccggtcaatcggcaacaaacgtaccagattgcgttattagatcatgatttattcattccgtttttcccgaccattaatatcagtggtcgaactgagatattatttgaagccatgttaagaacggttgttggcgattacttaatgcgtcgatggccggttaaataagagaaaggtggtgtcagtgtgaatcgcgaacatattgatgaactagctgaacaacaagcggaacggcggcgcaatttgtatcatggattacgaactgataagacccactttgaagttagcaagcacccgtttgaaatcgtgtacgattatcgccaagggtttgacctcgacaagttcgttgagcgctacagctcaattttaaataaatatgattatattgtcggtgattggggctttgaacagttacggttaaaaggttttttccgtgatgatatgaaagatgtccagcgctcacagacgattggggcggtccaagactatctgtacgaatattgtaattttggttgcgcctattttatcattaaaaacgaacgggtcattaaacctaagcgtaccagtcgctcacgtaaggatgatcggcggggaaagaaaaacactaatagtcggcaatcccgagcgcggagtaaccgtaacagtagtcgcagcaaacaacggcggaagtctcatagcttcaccactaagcagaaggccgcaccgtttactgaaaagcggcggcaaccggcgaaagttacggccggtaatggtaagcaagcgcaaacaacgaagcagagtagtggtaaacgccactttacgattcgacaaaagtaggaacagagagaggtattttgattgggtaagtacaagggttatttaattgatttagatggaacagtttatcgtggtcgggaacgtattcctgctgctaaacggtttattgaacgactacaggctagtcagactgattttttattggtcacgaataacacgactaaatcaccagaagatgtggctgcaaacttagcgaacaatcacgatattcatgtgagtcctgcgaatgtttatacggcagcgttagcgactgcagactatgttaatgaccttgcaggtgatggtgataaaacgatgtacgtcatcggggaacttggcttgaagggtgcaatgttggaaaagggcttcaagttcgatgagcgcacacctagattcgtaatcgttggtttagactatgatgcgacctaccataaatttgaacttgctacgctggcaattaagcggggggctaagttcattggcaccaacgcggatactaatcttccaaatgagcgggggctagtgccaggtgctggttcagtaattgcgatggtcgaacgggccacccaacaacgtgcaacttacattggtaagccggagacaattattatgcagaaagcggtcgaccggattggtctcgataagcacgattgtgtgatggttggtgacaattatatgacggatatctcagcggcaattaactttgggattgactccttattggtgtataccggtgtctctacccctgaactagtggcacaacaggccgtcaaaccaactaatgagatcaattctttggacgaatgggacctagacgatggtgtggctaaataaatttaaaaatgcggctcagtggctgagtttatacttatggttagtgagtggcacgataattgtaacaatcaacgcgagctggttgtattttgccaatgcggttggtcaaaagttaggcgcaactgtgaatttgacattgggacggctgatgacgaactactatcagctgttagcatatcttaactttccgtgggtacccaaattaactatgaacgattttacggattcgacgagtgcgttggttcactttgcggatgtgaagaatctatttatgcttgattacggtgtgtttatcgtcacgagtgttgtggtctattttttttggcagcgactacgacgtgatcgacaattgtggcggttagtattaccgatgcagacagccctctgggtaccaccagtagtgaccgttataatggctatcaattttgatcagttctttatcatgttccataagatcttatttcgcaattcggactggttgttcgatccactattggaccgaatcattttggtcttgccggatacgttcttcggtcagtgctttgttctagcgtttatcctgattgagtggtcttttttttacttactcagtatcggcagacaagcgttacgtgaagcggattaatgaagagtatttacagtggacactgcattttaagttagattataaaaggccggtcagctattattagctgatcggccttttataattggattaatcttcgttttcagttggatggctaaagcgtgcgcggatagcagagaagacagctggaatcagtgaaaccaggatgattccaatgacaaccatcgaaaagtgttccttaacgaacgggatattaccgaagtagtagccaccaccacaacagagaatgacccacaggacacagccgataacgttgtagcgaatgaattgttgatacttcattcgcgaactggcagctacaaatgggacaaaggttcggatgattggcatgaagcgtgcgatggtcacggtgatgccaccatgtttttcgaagaatttttcggactttgccagctgtttttgattgatcagtctaccaaaccaggatgtttcagttaggcgttctcctagggaatgaccaatatagaagttaagtgagtcgcccgccaaagctgccaccaagaagagaatgacaaaagtccagatatgtaagccataggttggattagcggcgagtgcgcaagctgcaaataaaagggagtcaccgggaagaaatggtaaaatgaccgcgccagtctcaatgaagatgatggcaaagagaattaggtaggtccagattccaaaactattcacgatggtgactaagtgctggtcaatgtgcaacacaaaatcgattaaaaaactcatggttacctccaagtaatgtgaaattaatcctatctaggttaccagaaaatcagtggaaatactatgcttagtcgctaatcgcaagaaatccttacaaatggctagcatttaatcgagttctcttgtattatcaagataatcttaatagaaaacgggtgattttgtggcatttccacaattagatttaagtcaggtcgatggaccaaaagcaacaatcaaaactaactttggtgatattaaggttcaactatttccaaagcaggcccccaagagtgttgaaaactttgttggtttagctcagaagggttactacgatggcattatcttccaccgggtcattcctgattttatgattcagggtggtgatccaaccggtaccgggatgggtggcgaaagtttgtggggtaaaccatttgaagatgaattctcacaagaggttttcaacttgcgaggggcattatcaatggccaacgctggtcctaatacgaacggtagccaattctttatcgttcaaaagccacaattagatgctgggatgagtgatcagatgaagcaagctggttatccggaagaaatcgtgactgcgtatggcaatggtggcacgccctggctagatttccggcacactgtttttggtgcagttagtgatgggatggatatcgttgataagattgcggccactgagactggtatgcaggataaaccagtgaaggatgttgtgatcgaaacaattacaattgaagattagttagtttgaaagaaatctgcggctgcgggtttctttttttgcaattacgattttgcaatccgctgtattcaggttataatattggggattagaattatcgacaatatagaatgaatgagaaaggatggtatgatcgtgagcaattatcgaattggtatgcgggtacacggacgagtcactggtattcaaccatatggtgcttttgtcaccttagatggtgagcatcagggattgattcacatttcagagtgtcatgaaggatacgttaaaagtattacggagtatctaaaggttggtcaagccgtagatgttattattttagatattgacgaatatactggaaaaatcagcttatcattacgttgtatcgagcatcaaccgcatccgacggtcaatgatttggaaatctacaagacttttcggcataagcatttttggacgaatcggcatgttcatgctggctttgaaccaattgccaatcatttagcgagttggacttcggattcactaaatcgattgaaagcgggtgagtattagtgcagaaaaaagttgccgggacaattatttataatgaccagcaagggtcgcactttttagttaagcattctactaatggatacaatttttatcagttgccagtacgagcagggcattcgcccttagcgtcagtattgtgggatttgcgatatacgattggtattgatgttgaccaattgcgcttgtatgattcgattatggctgagctggatgatgaaaaagttgcggtctttgtctttgaccacctagctgttgacgggcaggtacgtgcaaagtttgatcgtcaagggctcgagtttgttctagccagtgaattgcacgagttatttacgagtgttcgtgtgagtgaaacaatgccgtttacgaatttatcaaaataaattcgaataaagggttgacctgcatactaatacttgataatatatatcttgtcgctgcgagcactgctgttaaacagctagccgctagcacttacattgtttcatttcaaattgttgtaagtgaataaatattcaaaacagcaaaaaagttattgacatgagtaatcgctaatgataagatatttcttgtcgcgttaacaattcaactgattgaggcgttaccgattatgttatgataataacgtttcaaattcatttgcatagttattcaacttcttaaataaagttgttgacaaggaaatgatgaaatgatattatgtaatagttgtgttaagcgattaacgcacggaattagatctttgaaaactgaacaaagtttcgacgaatcaaatgtgtagggtctcttgattttgaatcaagagcaaaacatttgcgaagtcaattcgctagcaaataaattttagtacaaca

SEQ ID NO: 735 - DNA, 111706 bp, Unknown
  Metagenome-assembled genome
ggggcatctgcatgacactagaaattgacctagcaaatcaactttgttttagcatatacaatgccaatcggttatttaacaaattttatgtcgaaacattaacgccattcaagctgacttacgcacaatatctcgtactaatggcattgtgggaacgcgacgatcagtcactacacgaattgggtcaagttctgcgtttaagtagcaacactctgacaccacttttgcggcgtatggaagacgccgggtggttgcaacgggagcgcccagcaacggatcggcgtcaattggttattcatctcacaactcaaggcaagcaacaacaagcaccaatcgaagccgcgattgcaacttgtatcagtcgctaccatctgaccatcgatgaatatcagcaggctttggccttgaaccagaagatcattaccgcattatcacaagatttggcctagatgggcctttttattggctatttcaatcgtgcacgactgaattataaatttaggaggaatctttaatggcagattatgacacaatttttatcggtagcggtcacgcgacgtggcacgctgcagtgacccttgcacgtgcgcaacaaaaggtagcaatcattgaagaggatacaatcgccgggacatgcactaactttggttgtgatgctaagattttgttagacggccccttcgagctgaccgaacagctcaaacaataccaggggattggtgtcaacacaacgcccagtatcgattggtcacaattgatggcatataagcagcaagtcattcaacccttatcggtacaaatgacggccgtattcaagcaattagggattaagattattacaggacatggcgaactgactgatacgcacactgttaaagtggccggcagcacgtatacggcggataccatcgttgtcgggaccggacagcgcccagccaaattagctattccgggcgctgatctaatgcatgatagtcgtgattttcttgacctaccaaccatgcccaagcggttgaccttgattggtgccggaattatctcgttagaatttgccaacatggctgtgttactaggatctgaagtgcatattattgagtttgccgaccgggcactacctgcattttattcagagcacgttgaaaaaatgattgcacatttacaggcagccggggtacacttccactttggtgaagcccttagccaagtgactaaaagcgccacgggattattggcaaccactaagaacggcctgaccattgagagtgatgacatcatcacagctactggtcggattccaaacatcgaacacttagggttaacgaaagttggcattaagaccgatcggcacggcattatcgtcgacgaccatttgcagacaaatattcccaacatttacgctagcggtgatgtcatcagcaagactttgccgaagttaacaccgaccgcgacctttgagtctaactacattgccggccaattgcttggaagtacggccgcgattgattatccggtcattccatcggtcgtctttacgttaccaagaatcgcacaagtcggtatccctgtcgaagccgccaagtttgatactgaacactttcacgttcaagcactaccatacggtaaactgttagcctttcagtatcaaaacgaggtcgatgctgatctacaactggtctttgaccaagagaattaccttgttggcgcctccatctatggtaatggcgcaccagacttgattaacttactgaccatgattattactgatcacgtctcagccaacacgttaagtcagaagatttttgcctttccgagtgcttcagtgggtatcattgatatgttgacaccacttttacaccatgactagttttaaaccaactgaccaatttaaaagatactgtgtaggcgtcgcctatacagtatctttttgccgttcgagactaactcaccgatagttcatgcctagggcccctaataatttgacaagcaggataatggccccaccgagcgtccaaatgaagacgccccagcttaaccaactggcctgaacaaataaactgatcaaaatgaaccaattcatcccaaagagccaccaactgagtgtgcctttcagaatcattgaccatacaaagggtgtcgcataccgatttagcaggataatcacaagcaatagggccggaatgagcatactttcaaacattgccaaataatggtacggatcgctcgtataagcgattgcccccaataaaccatagtgatttggtatcgtcgttaaaagggctgcttgcccaatataaacgatgattggttggccaatcaacagtgcgagtaatccccaagttatctttttcatcagtctacgccgtccttattgtttaataacactatcttaccaatctacataggcgcctaactaccgaataattgtaaacttctcgtgaaaaagacgtaaagaatgagcatgattcgttcactatgttttcataacataaataataggcattttaaaaaagtatgcgtataataccttcttaataagtttctatgggggagttatgatgataatagttcgagttgcaattacgatttcagtcgttttttacttgtattttattattaatttattgttgatcaatcactatcgggagcccattcaaagctatgaaaaagggcccacaccctatgaattatttttggtcattccggtactcaatgaagaacacgtgatctcgcgcacgattacgcaacttactgaatcactcgaacaattaccgccaaccgttcacgcccagatcattgccgtcgatgacgattcgactgatcacagtctactgttgttaactcagtcatcgtcgcgcttcttacaaattctacaccgcacgggtaaccagcgtgctggtaaaggggccgtcctcaacactgctgtccagtatattcataagacgttagcactaaaatctgatccgcaacgaacaatcgtgggggtcctagatgcagacgcattcatgaatactgctgacttgacacgggtgctggcgcactttgaacaagaaccacagttggcgatgatccaaactagtgtgaacatttataatcagcccaactggctgaccaagatgcaaaattttgagtttatgggcgttaacaatgccactcaacagctacgcaaccgtcttggtcaggggatcgcgtcgggtaatggtcagtttgtccggctagatttagcgttgcaaaacccatgggggaatagcttacttgaggatctcgaatttactttgcggacttggctgttaggtggtacccgaacagcttttgatcatacattagttgtccagcaagaagctgttgaacaattacgaccgttttttcgccaacgggtacgctggtgtcagggtgccgttcaatgtatgcgttatctaccagcactttggcgttcgggacgtctgaaccattttcaaaaattggacacgaccttttggattttgatgcctatcagtggttgtatcgtgccactgaccagtctaatcacgttagtcgtgcttgtgagccgtagcctacaacattggcaagttgggtggcatcacttggctatcgggacattactagtgatcgctttttcggcttgtttggtattagcagcactgtatcaacgcaactgtgccgtcgtgaaacaacccgttggattcatgaatgccctcaaacaaagtttaagctttcaggcattcttattgatcattagcctgacgccatacgtcgccatttatcggcagttacgcggtcaaacagcgtgggctaaaacgcgccatggtgttacgacccgcgttgcaaaatatccagatactggcttaaaacgctcatattaagatgaaggtgcatgccgatgaagtggtgctataagatatttcaaattaccgttctcacgattgcagctgccttactcgggtggatgattgtcgccaactggcaagtcaacctgaaattacacctcgcaatcagtgcttggataggcgctggtttattcgtattgttcattagtgccacgattggccttggcagctggtggttgagccgccaccaaactagctggttagttgcagcactgatggggttaactatcttaaaatttccactagttgcagggttaaagatcgacccgacctcagatttctggaattaccatacactagccgcgtttagtgcccaaggattcacctggacccaactgttacaccatggtatcgttggcaattacgtcgtttttccgcacgctttaaatatcgcgaacggctacagtttagtcgcggcttttggcggggccaacttttttgtcagccaactaatcaatattgggtgtactttagtcgatatggtcttaatttactggctagtcgcacggtggctctcacgacaattaggcatcatggttgccctcattttttactggattccagcttattggctgtacggcacgctcttaaatggtggtgaaccgttctttttcaccagcgtcctgctcatgatgtatgcgctgacgcgggcattagtcccactcacgacgaccacaatcacggatcgacgactatacctagcgttagcgatcgtgatgactgtcgtggccaatatgctgaggccaatcatgggcgtctggctaattgcactgggtttgatgagtttgtgtgtcctgcttaaatctcaccacctttaccgcgttcaagtacgtcagctcctcatatacagtgcggtcgtgttaggactcatgttcacagcgactaatctcgacagctggttatatggctttaaggttgcgccagcccaagttgaaactttatacagcctggctacggggacagatgttaaaagtcacgggacctatagcccggcactacaagctaccgtcagccacgaattacgggtggcgcccacgttgacgcaagcctatccgcgaatcacacgaacgatggcgaggactttgcagactaatctcaaacaaatcaagccacagttggggtcatttgttaatgaaaaaatgcagggctttattcgtgaggattatggctatgattggagcttatataacttaagccatcatcccggtttgcttaaccgccactggttttatttagcccctatattgattacaagtgcgacggtttattggcaggcaatgctggtgattgcgttattcagtgttttaatggggctgggactgctatggcatcaacactatcttaaccactatttgctaatggcagcgcttttgttagacggtttcaccttaagagctttaccattagaagtacagggccgctatcatattatcttgtacttaccaatccttatgttgatgacttgcgggatcgcgggggccaagctctggcggcgtcaaatcaagcagagttgagtaacagtggcaatttcaagatcaatacccaaatgaatcgctagcgttcgaagctcactgaatgaaaattaaactgatgatataaaaaagattattgctgacagtagtgactgttacttcagtaataatctttttataatgtttaaaaggggacagatcgtctaatttgtactatcaaattattgtggctacggtcatagttaatagctggcactgccagtatcgttagcaaataccacggatcaattgactttaatggcccgtaatccccatttactaatgccgattgggtgctcgtcaaggtgccaggacagcccggtgatgaccactaaatgattgattgctcttcgccaacatgtcatggcaacgggtttcaagctagggcgacagtcagtactatgggcgatggatgacgctgttagtggctggggggcggttcggcgtaaaattacgcgggctagcaaaatcattgctatgagccgtcatgtcaatccgccaggcttcagccaaaacgtgcgttgcaatggatattgtcgtcaaaaccattgaattgcccaattgatccgataaaactggtgctgaagcggttttagaatgcgttgaaatggaataggcttaagagtagggcgaccgggtgctatttttggccgggtaggggttgtcacaaaaggttgaaatgaactccaacggcccatttgcgtaatatcggtttgcatgatgacattgcgttcgtgacaacttgctgcaaattacacaattttattagccgtggtattgaaagaacccatcaccccggtaaattattcaccaaacttttgatctagcacatgtccaacaaacatatgaggccatggcgaattattgttcgtagtctgcaataattgttgacactaaattgaatggcacaatcagctttaataaatacgcttaattttaggactaatggtctgaaaattaacaagttgtcaagccacaattctgactaataatcgccaaaaaacagttgaaagctaggctagttgccgctaattacctgggcttcatgcaaccgcaggtactcaaggatgccactcacatttatggtgttcagcccgcggcctctaatataaattacggtagactgatgtggttgtcgacaagataaattagtattacagactggtctaaattacacatctttaacatttttgaacgtggctgatgattcagttaagcgcgtgattgaacactgtcctgatacggtttttggcgtttctggtccatggcaaatcatgtcttttgaaaaaataaggctgtcgttagcaaaccatcgattcaataaatatgagcaataacatcattaacacagtcaaaagctatttcatgatgcatggtggccaccttatgaaccataatcatatattcacggtaagtcacatcaataatatgattcagtgagttcagtagattttataaaaatgtgccataaattaatttgccacccaaaaattatcgctgtactagcagtaaacttgatgacaattcacgcgataaaagcggtttgttgtgattatgatggtttatgtgtggattatgggtaaatctagctagggggctttttttacattttctagtttacataatatatattatacaaagtagaattaaaaacaaaattgctcccccacgacctgatttaggtcccctgtggtaattttttgattttaagttagctttctggtgattcagttctcagattgtcattttgtcgcaatcattttgctggttctaactgttcagaatttttcaagacgtccgcttaacttaaattattttttatgattcacaaacatcaacactaaaattagtcgattgaatttcaaccgagcatttttcgttaattcggatcaacttatctgaatcactaaaagttcaaatgttttcagactcctaaatccaattatcactagtttgcatgcacgctcatgatttgctgataactaacatcgattttacggtttatttaagggacaactcttcaactaataaacgaacacgcgcttagaacgcgtctctcagcatcggtcaaatcgcttgtttttgttgtaaatttatgttttagttaaagtaagaattctaacccagaaaggatgtcctactatcaatgaccgctaaatttccgtatgctaaaagctttctcgcctcattagaaactgctggcaagcaagctagtacgattgagcaatatgaattaaccttggctgactttttcaactatgagcagcatttcaatgagacctttgctaaggatcaattactagcagatttaactgagaatgatattcaagcttacttggcaatgctccgtgaacaacgccaattcaaaacatcgacactgaacaaatgtctgtcgaatctaaacggctactttagctatttattttcacaccgaattattacaactttaccaacctttacaattaaagggcaacccttgaccaatcgtcaacaaacaacgacctggccagagcaattagcggcatggttagcaatggatgatctgcatccatacacccgcttattcttgttactaacgaccaagggttatactgccacggagatgctatccccagggttttatcagcagttgaatgcaattacctttacagcagtagaacaggcttttctggttaaactacgggcctatttgcagccattacagactcaaagtggtagttcggacctttttttaaagcagcgtcaacgcggaaccgacccacatctcaccctcgcggcattgcataaatacttggcgggtgatagtcaacgtttaggtgtgccattaaagccggttgcattgcgccaggacttcatgctgtggtttctcaatcaacaccggacgaccgaaccgactgagatcatgcaacaactacggttagatgaaaccagcctcgaatattaccaaaacttgctacgacaacgtgatttgcgaactttaaaagccactaaaaccgactaagtgacactgatgggctaactgctacagttagcttttttagttaaagtaactttacgttgttgcacgatctttacataactttacaaacacgtcacaagcattacgtggaatttgctagttaattaagaagccttaaaacgcctatacaacgcgcctttttgcagttaaactagttttattgaatttaactaaagtattgaaaggatgatttgatgacattctatcgttggttagaaccgtttattgaacaaaatggtccgttcgcgccagccgcttgttatgcgcactcagattttgattttcctttgactagtaatgttcatgaattatctgattatattacttacttaaatattcgtgactcagtcaaaaaatcattttattcagcattggacgcgtaccaagcaagttaacaatcataattgaactcaaaaaccaacctactagcccagcgacgattgctgtggttgcaggttggtttattcgtgtttttagccttatttttatcgagatgagactcaaacgatacgaagatcgcaaatctgagccattttcaacgcttaatcaccatctagcttattgccaatgttgcttaataaacgcctcacgaccacccatttcttcgatttgataacggaatggattgcgtcgataaaagtcttggtgctcggcttctgcgggataaaatggcttcgcatcttcaatggttgtcacaatcggctcagcaaacttaccgctagccgcaagtgcatctcttgaagcagttgcagttcgacgttgagcttcactattaacaaaaattaccggtcgataactgtcaccacggtcctgaaattggccagaagcatcggttggatcagtctgacgccagtaaatttcgaccaagtcagcataactgattacatctgggtcaaaagtgattttaaccgcttcagtatgcccagtcgtgtggctggcaacttgttcatacgtcggattagcgacggtaccaccagtgtaacctgaaatgactgacttgatcccgggctgttgatcaaacggtttgaccatgcaccagaaacagccaccagcaaatattgcagtctctgtcatctaaattcctcccgtttattaactcaattatttaaataaactctgatactgaccataaccagccttttcaaggtcggcaactggaatgaacttcagtgctgctgaattaatacaataacgaagcccgccgcgatctcgtggcccatctggaaagacgtgacctaaatgtgagtttgcttgtgtgctagtcacttctgttcgatgcatgccaaacgactcgtcacggtgttcgttaagattagtctgatcgattggtttagtgaaggatggccacccacaacccgcatcatatttgtcacgcgagctaaagagtgcttgaccactaactacatcaacgtaaataccttcctggtaaaagttatcatactcaccgctaaatggccgttcggtcgctgcctcttgagtaacggcgtattgttcaggcgttagacgctgtcgtaattcaccctgctgtttatccattactatcagtccttccataattgagttgtgtacaatctaattacagtatttatcataccccaatctagctagaatgcaaaaaagaagctccaacaagtggtagcttctttttaaattaatctgtaaattaagcgttgaaggcgtccgttaattgagggacaacttgcttcttacgtgaaacgacacctggtaagcttaaccggttgttagcaatcgtcttaccaaaggctttttcaacaggttccgttgggttaccaacgactaataattccgagttactatctaagatattagtagccaagattaagaataaatcatagccgtcactcgcattttcgtcttttgcagcagcttctaaagcagcttgacgcttgaaaacatcatccaagtcaactgtattgatttgcgcaacgcgcacggtcttgccagccatttcaaatgacttcgcatcggcatcgattaattccttttcagtcttgctgtcaaggttagtgcccgctttaagcattgctaaaccatacgtttcataatcaatatcagcaattttagctaagtctttaacaactgccacgtcagtttccgttgtggttggggactttaagagtaatgtatctgaaatgattgcagataacattaatccagctaacttggctggaatttcaatgtcattttctttgaacaacttgtaaatgacagtgctgcagcaaccaagtggttcagcccggtagaataatggttgggccgtgtcaaaaccagcaattcgatgatgatcaaccacgtgactaacagttacgtcagcaatgtcactcacactttgttgaggttcgttatgatcaacaagcataacactgtcaacttcatcactggccttagtaatcacccgtagtgctggttcatcgaagtaatccaaaacaaattgagtttcttcgttgggttcgcctaatgcaactgcttcagtgtccgctcccatcttattttcgtagtatgagaacgccttagccgccacgattgcgtcggtatcaggattttgatgtccaaaaactaattccttactcattagcacaaaactcccttaaaacttatttttgattaatcttttgtaaccgtgaaatataatcttcggtccgtaagtaggcatcaaattcatcaaggaaattcttgattcgcggaatttggtccttatctttacggaagacaaaatttaagtcaaacttgatggctggttcaaatgacaacgtgtggagcttatcagttgccggattagccaccataaatgaatttggcaacgccgtgttagtattagttgctgccacaaagcgataaatctgttgtggcgtcgtaaaccgtgcgactgccgttggcaaatcagccaactggttcttataagattccttaaccacttgatccaagtaatagttttcaggatacgtcacccatggattgagcgtcgtatctttgaacttgatgcgcttcttcttcgctaacttctcgtcacccgaaatgaatagcaattcgtcttggataatcttcttagactggtatggcttccagttcttgatactttcatcaggtaggtacatgactgccaaatcaatccgattattttctaatcgttcccaaatctctttacgcgtcagcatgtgcaacgaaataataacatttggattggcctcgtaatacttaatggcaaaatcctcaaatacatggtcttcaattgaagctagcacgccaatattgattgttccttgagtagcactagttgtctgctggatttcatcagttgccttgttcaatacactataaatactgtgggttgcgttaagcattgtgtaaccggcgtcagagagacgtaactttttcccaacggaataaaataaaggggcaccaacggtacgctctagttttttgatctgttgggtcaatgctggttgcgtaattcctaaaatttgagctgcctgtgtgtaattcatagtttcagctagttgcaagaaatacgttaacgttttcgatgagaaaatactttcttgagttgtcttcatgaattttacctgatcctttcttcttatcgccatcttatgatatctataattttatacaagattcaaagtgaaagcaagcggttgttattggtaaataaagcttaactaattcataatcttttaccctgttataatattatcttaatcgaatgcccgttaacgtgcaagtattcgcattggaaactataccgttagtgggatcggatggatctgcatagaaacaggttccccttcagtatcagtatcaactacaaaagagccattagaataacgcgcactagtaggatgatcatcattcaagatcgaatggtgcttaccacgatcagtcagcacatcaagtgcaaccccatttgcgtcactagcaactaagacataatcagcgacccggtgtggattattttttaactcccgtaagacttgaacgccccgccgtgcacgacttgtcacgggtaaatctgccaccttcatcttcttgaatgaaccccgttgcgtaatcatggcaatcaaatcatcatctgcggcgattgttgcccgtacaatggcatcgtcgcgcagatccatagatttcacgccgaccgccttcgcaccaatcgttgggacctcgcttaaatcatagcgaaggccatacccatgttgcgttatcagaatcagggttcccgttggtgcagctggtaagtattcgactgttacaacggttgcatcgtctgacttcattttgatgaactggctggcccgagtcttataagttcgacccggcgtgtaatcagcaaaggccgtttgtttgatatagccgtcactagttgccactaagaattttccggtagctttaaggttctcaaaagaatagacccacgtgatgcgctcgttttcagccagcccaatcgtctgagaaatgtgctcaccggtatctttccatttggcgtcagcaatttcataaatcggccggtaaatgagatggcccatgttggtgaacatcattaaatgatctaacgtgctatttttagctagatagatcggataatcctcatctttaagcccgttatcatcgggctcagacgctgaataagagcgtaagctggttcgcttgatataaccatcatggctaatcataacaatgacgtcttcttgtggaatcacgacctcggtcttgacctttaattcttgaatttcattttgaatctcagtcaaacggctcgttggataggctttttgaacggcctttagttcacgccgtaaaactttatcgagttctttaggctctgccagaatcagctgataggttgcgatagccttggccagttcagctgattctttttctagctgcgtcacatcggtattggttaaccgataaagttgcattgtcacgatggcttcagcttgaatctcagagaaatcgaattgactgaccaagttctgtttggcgtccttcttatccttgctaccacgaatcgttttaattacttggtcgaggatggacatcgccttgattaatccttgaacgatgtgttggcgatccatagccttctgtaagttaaattgggtccgacgggttacaacgtcccgttgatgttccaagtaggccgttagaatcgttttcagcccaacgtgttcgggccgttgatgataaatggcgaccatattgaagttataagtaatttgtagatcggtatttttgagtaagtaagtcagaataccttctgcattgacgtcacgcttcagttcaatcaccactgataatccctgacggtcactttcatcacgaacttcggcgataccttcgatcttcttcagaatgcgaatttcatcaatttttttcaccaattgcgccttgttaacttcataagggatctctgaaacttcaatctgtgatttattccccttaagcggtacgatcttggttcgcgaacgcacgacgatacgcccacggccagtttcataggcttgcttgatacctgctaatccttgaatgatccccccagttggaaaatcgggacccttgacaaagtccatcaaatcttcaagcgttgccttagggtgattcatcaggaataaaatcgcatcaatgacttcactcaagttatgcggcggaatttccgttgcataaccggctgaaatccccgttgccccgttaactaataagttcggaaagcgggccggtaaaacagttggttcgtactccgtatcatcaaaatttaggaccatatcgacagtctttttatcaatgtcttgaagcatttcaccagcgattttgctcaaacgtgcctcggtataccgcatggcggcagccggatcaccgtccatggaaccattattcccgtgcatttcaatcagcggttcccgtaacttccagtcctgactaagacgaaccattgcttcataaatcgaagaatcaccatggggatgaaaattacccatgacgtttccgactgatttagcggacttacggaacgctttgtcaaaggtgttgccatcctgattcatggcgtataagattcgtcgttgtactggcttcaagccatcacggatgtctggcaaggcccgttcttgaataatatatttagaataacggccgaagcggtcgcccatgacgtcttcaagggttagttcttgaatttttggttgttcagttgccattttacgaccccctctattgttttagctgttgtgccaattcttcgtcggcttgctcatgtgcggatgagacggcctcgttatctagtaacgacccgtcttcgtccaaattaaagtggacgttactttcgatccattttcgacgaggttcaactttgtcgcccattaacgttgtgacccgtttttctgctaaggcagcgtcatcgattcggactcggactaaggtccgtttttcaggatccatggttgtttcccatagctgttccgcgttcatttcgccaagtcccttgtagcgctggagtgcatagcccttaccaaatgacttggtcttgagcgttagctcttcgtcagtccatgcatattccgtccgtaactgcttgttctgcttcttttgtaatcgatacagcggtggcaacgcaatgtagattttaccagcgtcaatcattggccgcatgtacttataaaagaatgtcagtaagagaatttgaatatgggcaccatcggtatcggcatcggtcataataatgatcttgtcataattactggccttaatatcaaattcgggaccaacacccgcaccaattgtgtaaatcatggtattaatttcttcattcttgacaatatcagctaatttggccttttcggtattcaacaccttaccacgtaatggcaaaattgcttgaaactttcgatcacgcccctgtttagctgaaccaccggccgaatccccttcgactaagaataattcattcttcttagcgtttttagactgcgctggcgttaattttccagaaagtaaccgttcctgcttatggcgccgcttaccgtttcggctttcatcacgggccttacgggcagcctcacgagcctgccgagctttggtggatttgcgaatcagcatttgagcaaattcaccattttccatcaagaagaattgaagttgttcactcacaatattatcaacaatcgttcgtgcttcgggtgttccgagcttttccttagtttgaccttcaaattgtaagagattttccggtactcgtaatgaaataacagcggataacccttcacggacatcggagccttccaaatttttatccttgtccttcaataggccaaccttgcgagcatattcattgaatgctttcgtccaggcactgcggaaccctacttcatgagtcccaccgtctggcgtccgcacgttattgacgaatgacaacaagttttccgaatagccatcgttgtactgcgcagcgacctcaacttcgacaccttccttagtgccgtcaaagaacataatatccccgagggtgtccttatcttcattgaggtaactgacaaacgccttgataccatcttcgtaatggaagaccagctcttgttgttgattttcccgttcgtcagtcagcgtgattttgacgcctttcagtaagaatgcggattcacgcaaccgttcagccaacgtttgaaaattataaaccgtcgttgtaaagatactagcgtccggcttaaaagtcattgtcgttccagttggcttattagtcttccctttcttttcaagggtaccgacgggatgacccccatctttgaaatgttcaacgtagcggtagccatcacggacaatggttaccgtcaattcggacgacaatgcgttaacgacgctcgcaccgaccccatgcagcccaccagaagtcttataaccaccctggccgaacttaccaccagcatgcaaaaccgtgaggataacttcaggtgttggaataccggaagcatgcattccaactggcatcccacgaccatgatcgacaacggtgatgctgttatcggcgtgaataatcacgttgatttctttaccatagccagctaaggcttcatcaacggcattatcgacaatttcataaactaagtgatggagtccgcggccgtctgtagaaccgatatacattccgggacgtttccgaacggcttctaatccttcaagtacttggattgaagaatcatcatattttgggcttttcttggccattctcacaactccttttatctttaaaaatctacctcaactaggtgcggctttcaggtaaccgtaataaaatagtcctaaaagccccaacctgtcaaggtacaattatgttaatttctaattgtcacttgtggctcttcatctgttagcatacacgttaacaattaaaatagcaaacacacgttcgcgtttaaaactatcttttaaaagttaagccacttactagcttacctcatgttgattctaagcgccagttcaatgaataaacttattactggtcacgactagttcttaaaatgcgtgattaatttgacagttagcgctttaaaggccctaaccacccgcttttaggcacataataattatcaaaaaatcattttattttcataatttgacacgcaatcatcattttttaaactaattaatccccacaatcttaaaaagaatgctaaaatattgagtgattatattgcaggaggaaccaactttgaaaataataattatgctgatcatcgcctacttaattggcgcgattccttcgggtgtcattattggcaaatttttctttcacactgatattcgtcaagcaggtagcggtaatatcggaactaccaacacgtaccgggtcctaggcccgaccgctgggacaattgtcatggtgatggatattctaaaaggcaccatcgcagcactacaaccgaccttgctatttcatatgaataaccggtataccttattgattggactagcagctattttaggacatactttctcaatttacatcggctttaaaggtggtaaggccgttgccacgagtgctgggatcttattggcctacaactgggagttcttcttaattgctagtgccatcatgttattattggtttacacgaccagtatggtcagtgttgctagtatgacggcttttccaatcgtcacgttgattgcaattttttactatcaggattggttgctatcactcgtggcctttgcattgaccctcttcatcttctatcggcaccgcagtaatattgcacgtatcaaaaacgggaccgaatcattggtacacttcggacttggttggcgacgtcagcaacgggctaaccgcaaataattatgttactttcaagaccatttcattactgagtggtctttttatttaggaacgggtaagctttggtgctgggtttgtattttttgtttctagttaaagtaagatgatacaattctttattttgctatcttttcagaccacaataaaaaaccggtcaaacctgtcgaccggtttcactaaaccacagtattttagttagaaaaagctaatcgcatatttagcatcaaacgtctggttcgctgcaagccgattaatgcccatcttatggcttaattgaccatcgctatcaacgttatccgcaatgccccaccatggctctaagcacacgaacggcgcttctgcggggtatggtgaccacatgccgacgtatggtgcatctccaatcgtcatcgctaccccatgatcatccagatcagtgtccaacattaacgtcgtctcgtgatgattcaaatccaaaatcagggcatcgtccttaaacaaatcccggctaagtgctaatggcttggtcaggtcgaagtcatccgcatttgccgcatcgttcaacggtgcctgtaatggaatatgcgcgtagacatttcgtggtgccacagtaaccttataatcagctagtgtgcccgccggatcagcgagtggtacgttaaatgctgggtgcccaccaacagaaaataacagctcttgattagctggattatgcacattgtagttaacggtcaattcatgatccgtcaacgtataaatcaaacgtaatcgaaacgcgtacggatacatctcccgcgtcgcacgactatcggtcaattcaaatgttgcttgtgtggccgtttggttgacgaccgtaaagtcattgtcgcgggcaaaaccgtgctgtcccatgtgataagcctgaccagcaacggtatactggtcatcctttaaacgaccaacgattggaaaaagcacgggtgcgtgccggccccaaaaagttttgtcggcctgccacatgtactcaataccgtcactcgacttgacactacttaattccgccccagcttcattaatcaaaacggtgaggtactcattctttaattcgactgtcatccgcgtaaacgcccccttgataaattttataagatgtaacgactaagatccttatcctgtgcaatgttaccgattcgctcgttgacatagctttcagtgattgtgacttcgcccatttccatgtcaggaccttcgtatagcaattcttccaagagcttttccaaaatggtgtgcaaacgacgggcaccgatattttgtgtctcatggttgaccttataggcaatcgtggcaatcgcttcgatagcttcaatcgtgaacgtcactttaatgttgtccgtaccgatcaaagcgatatactgcttaatcaacgcattcttaggttccgtcaaaatcttaacaaagtcatccttgcttaaatcgtctaattcgacccgaattggaaaacggccttgcaattcagcaatcagatcactaggtttactttccgcaaaggccccggaagcgataaacagaatgtgatcagtattgatgggaccatattttgttgaaatttgtgacccctcaacgattggcagaatatctcgttgaaccccttcacgtgaaacttcaccggaaccttgctgaccacccttagtaatcttatcaatttcatcgataaaaataatcccggtattttcagcacggacaatcgcatcatgataaatatcagcgttattgactaacttttcggattcttcccgaactaaaatttctcgggcctctgagactggcattgtccgttggatccgcttcttgggcattaaggcacctaaactatcaccaagatcaatacccatttgaccaagcatgttattattacccgcggcggcttgctgggggtcatccatctcgatggtaacctctgagttttctaagcgccccgttttcaactgatcggcaactgataatcgttgattacgaacttcatcggtcacttcttcgttacttgaatcgtcaacgttgggggtctggccgttttgcatctggctaaacatgttcatcatgttttggaactcgttaccattgttcttagcctgcttcttttgggccggtactaataatttgacgagccgtttgtcagcagcctgcaccgcttgtgcccgcacaccagaataagcctgttgtttttccatctcgatagccacgtccactaagtcacgaaccatggattcaacatcgcgaccaacatagccgacttccgtaaacttagttgcttcaaccttcacaaacggggcgtgcacaatcttagccaaccgccgggcaatttcggtcttcccgaccccggttggtccgatcatcagcatgtttttgggggtaatttcttcctgcatttcagcagaaagttccatccgccgataacgattacgtagcgcgatcgccaccgcttttttggcttggttttgaccaataacataattatcaagcgcggccacaatttgtttcggtgtcttattgatttcttccatgagcgtttcctcctacattacaacgtttctgagatcacattatgattggtaaagatatcaatgtcgccggcaatatggattgccgcttcagcgacttccttggcactcatatccttagcatgtagctgcattgcgcgagctgcggctaaggcaaagttaccaccagaaccaatggctaagacgtcgttatccggcgtgattacttcaccactcccagaaacaagtaacatgtcatctttgttcatgacgatcaacaaagcttccaatttctgtaacgcctggtcactgcgccattcctgggcaagctcaacggctgcccgttgtaaattcccagaaaattcgttgagtttcttttcaaaacgatcttcaaggttaaacgcatccgcgacactcccggcaaaacctacgacgacctgatcattataaatccgccgaactttatgggctgtccctttcattacgactttttcacccatcgtgacctgaccatcaccggccatggcgttatggccgttttggcgaacggcgcaaatggtagttgcttcaaatttcgttgtcatgttcagtctcctttgtcgattcccgcgttgcccgtgggaaaaattgacgataatcttgttgtaaatgttcctttgtcacgtgcgcataaatttgcgtcgttgacaaacttgtatgacctaacagctcctgcacggtccgtaaatcggcaccattattcagcatctgcgttgcaaacgtgtgtcggagcatgtggggatgaatatcagccgttaaactacttttcttaacgatttgattcaagacatattcgattccgccgccagtaatggggccgccgtgacgattaataaacaccgtttggtgcgtttgaccatacttggccatcacgggctgccggcagacggtttcgtaatgctgaagcgcggtagccgcgtaccgaccaaatgggacgtaacgttccttgtcgcccttcccacgaatcaacatcatttttaggtcgtaatcaacgtcggctaattgtagatcgacacactcactcagccgaatcccagtaccatacaggacttctaataacgccgcgttccgggcccccatcacgctatcatccgcatagacagtttgaaataatacgtccagctccttttgatagaaaaaacggggtaagcgcgccgcgtgttttttgagttggacgtacacgaagggattcaatttagctaaatcattcttaaccaaaaagttatagaacgaccgcaagcttgaaactttccgagcaattgaattgcgggtcaagtgccggtcatataaatgacttaaatagacgttaacgtccaaccggtcaacttcagtatacgctttcgcgccgccatttgccgttaagaaatcattaaaagcttgaatgtcttcccgataagcagcagcggtctcttccgaatactgtcgttcaacccgaatgtactttaaaaagagggttaaataatccgtttccatgcaaaaacctccatacgttgctactttagcaaagtatggaggaaaacacaattatgcaccctgtcaatggggcaatattttagttgttaacggtcaatgtttcatctttaaaagtcgtcaggtcagccaaggcccgttcagaaatcgccgtattacgctcacgcttatcccgaatgcgctgtttgagttttggcataatgccaaagttggcgttcatgggctggaagttgctagcactcgtatgcgtgatatagtgggccatcgcccccatcatcgtgtccgttggaaaaacgaccggttctaaaccaagtgctaagcgcgctgcgttggttccagcaacgatgccactcgctgcactttcaatatagccttcgacacccgtcatttggcccgcaaaaagcaaatcgggccgttgctgtgtctgataagttggcgttaatagtttcggtgacttcataaaagtattacgatgcatgacgccataacggacaaattcaacgttctccagacccggaatcagtgaaaagacccgtttttgttcgccccacttaagatgagtttggaagccgacgatattatatagatcaccagcggcatcatcttggcgcaactgaacgaccgcaaagggttgtttgcccgtcttcggatcttcaaggcccactggtttaagtgggccaaatagcatcgtttggcgcccacgttgtgccatcacttcgatcggcatgcagccttcaaagacatctgaattttcaaaatcatgcgcttcggccatttcggcgtgaatcaacgcgtcatagaaaacgtcaaattcggcttccgtcattgggcagttcagataggccgcttcaccacggtcatagcgtgatttgagatacaccttgtccatgtcgatcgaatctttcgttaaaatcggtgcggccgcatcaaaaaagtgtaagtcatcttcgtcgttaaacgcttgaatcgatttcgctaaggacgccgccgttaatggtccagtcgctacgaccgtaatgccatctgggagactagtaatttcttcattaataatttcaacattaggtaacgcggtgattgcagccgtgatttctgcagagaacgtatcccgatcaacggctagcgcaccgccagctgggacagcgtggtgttcagccgcttgcatcacgatcgaatccatctgccgcatttcggcctttagtaggcccgccgcgttggctaattggttcgcccgcagtgagttcgtgcacactaattcagcaaattgcgccgtgtgatgggcgggagtcattttgctgggccgcatttcatacagccggacattgacgcccatattagcaatatgccaagcggcctctgagccggctaaaccggcgccgattacgtttactgttggtattgatgccatccagaattcctcttttcttgttgtcataccattgatagtattgttgtcatcatacctgagaaactagcagaagacaactaatggcatcagcaaatcctgcaatgacatgtccaccgtcaagcttaaagcgaacattaatttaaacgggcgtttattttcccgataaaacacttgttaatcagttgaaattgcgaattttatcaacgtattttcacaaattgtacgcattgtttgacaatgcacaaaaaaagatcatccgtagatgaccttttcttcatttatttttgaacgttttcggtataatcgccattcggacaaagcacttgcttgccacctttgaccttcttttcgaccaggtaatggccatccttcgggcaatcacggccaaccggtttatcccaagagacaaagtcacaatctgggaagcgggaacaaccataaaaaatccggttcttcttcgatttccgctcaatgacctggcccttcttacattgcggacaaacgacaccaatttctttaacgattggcttcgtattacgacaatccgggaaacgggagcaggcaaagaatttgccgtaacggcccatcttcacaaccattggcgcgccacaaatatcacaattgaagcccgctaattcgtctttgatttggatcttctccatactttcctcagccgttgcaacttctttagaaaacggcttgtagaaactatcgacgactttgacccagttttccttaccttcttcagtcgcatccaactgttcttctaaactggcagtaaagccgacattaacgacatccgggaagtattcctgaataatatcgttaacgatctcaccgagttcagtcggcacaaaccggcgcgcttctaatttgacgtagtagcgccgctgaatcgtatccagggttggtgcgtacgttgatggccgccccacaccattttcttccaatgctttgatgaggttggcttcagagtaacgtgcgggtggctgggtgaagtgttgttgcggatcagtcttcgataacttgaccacatcaccttcacttaaatctggtaagacgttattcttttccgtcttatcgtagatcttcgtaaaaccagcaaacttcgtcttcgacccgttcgcccggaattggacgtcattttggtcgatcgtgaccgccattgtatcaagtacttcgggcgtcatctgactagccacaaaccgtgaccagatcagctggtataaccggaattgatccttcgtcaagtagtctttgatgctagctggtgtccggaagacggatgagggtcggattgcttcatgggcatcctgagcgccttctggtaacttgcccttgacaggtttggtggccgcatattctgcgccgtattctttatgcaagaattgtgacgcttcgtgcttcgcaatcgacgaaatccgcgtcgagtcagtccgcatataagtgattaagccgacgctaccttccttaccaccaacattgatgccttcatataattgttgtgctgccatcatggtcttacgcgtccggaaattcaacttccggttggcatcctgttgcatggtagaggttgtaaatggcggcgccgggaaccgtttacgttcttttttgacgactttgacgacattaaaatcgccattccggtctaattggcccaagattttttgcaccgcatcgttgtcatccaacggttgcttcttaccatgggttccataaaaacttgccatgaatttggaacgacccttttgaaattcactatcgatcgtccaatactcttggggtttgaacgctttaatttcattttcacgttgaatgatcaaatctagcgcgatcgattgcacccgaccggccgataacccctttttgacctttttccacaataatggactaattgagtaacccactaaccggtccaaaattcgccgggcctgttgggcatccactagatccatatcaattgaacgcggttccttaaaagcgtttttgaccgtatccttggtgatttcattgaagacgacccggtttttatccttagggtcaagtcctaataaataggataagtgccaagcaatggcttccccttcacggtccgggtcagatgcgaggtacacggctttggcttttttagcctctttccgcaatcctttgatcacatcacccttaccgcgaatcgagatatagtgcggttcatagtcgttatccacgtcgacacccatcttgctcttcggtaaatctcgaatatggcccagactagcgacgactttataagaacgacctaaatatttctcaatcgtttttgctttagatggtgattccacgatcaccaattttttagcgggcgttttgcttttccgcttggtagcagttttagttgcggtcttccgctttgccgccggtttggctttagttgtacttgcagccactcgatcagctccttacaggtttcattatcattattataaatatcagtttaagaaatccctgtaatcatatttcaaaaatttcgtgttgtcaaatttttggtaaaaactcttctattatatgtcgcgaatttaagactggtttggcccccgcaacgatcaattgattgcacccaactgaaaatggtgcatcaattggtccaggtaccgccagaacgttgcgattgttttgtaacgcgatattagcagtgatcagactcccagaatgggcctgcgcctcgaccacgataaccgtttggcacagcccggcaataatccggttacgagcaacgaagtggtatggttccggacccacccccagcgggtactcactgattagtaaaccgacctgactaatttgctgctgtaggtcacggtgttgacgggggtaactaatatccagcccggtcccaatcaccccgattgtcggtaagttaaaacgaagggcggtccgatgtgcaaaaccatcggctcccttcgctagtccactgacaatggtcaactttgccgttgctaacgcacgctgcccgcgcaaaaacaacactaatggtggttgataggcttctaataaggccggtgggtaatcatcatccaagattgttaaaatatcaagctgcgcatggcgttttagtcgctgttgaaacgccatactttgccaatcagcggtaaaacgcccctgctgactagcagttaaatgggccaacttacctaatcggcggggatcagtgacgaccgtctgaacctgccgacagtgttgtaacacgcgtaccatcccggcatacccgatgccgtgcgctaaatgtaatcgaatcaataaacttcttaattgcatgttatcacgactccttaagttcgcccttgttgacattagtcgtcaacggaacggcttctttaaagagtagttacggatttagacccgcttagcatttcgaaccggtgaaaaagattggcgatgaatcggcgtagcgccgagactggccaacccggccaaatgcttagcagtcccgtagcccatattatcagcaaagtcgtacccgggatacacttgatcatacattgtcattaagtgatcccggacgactttggcgacaatactagccgccgagatgctcgcgcttttcgcatcgcccttgattagacgggtctgttcaattggtaccggcacctgcatcgcatcaactagtaaacgtgttggccggacggacaggttacggacggcttgggccattgcgactcgggtcgcctcataaatgtttaattgatcaatttgttgggcatccgcaacgccgattcccacggcaaccgcttcttctaggatccgtggcatcagggccgcccgtttcttagcggttaattgctttgaatcattgacttctagcaaatcaaaatgatcgtccaagactacagcggcagttacgactggtccagctaacgggccgcgaccaacttcatcgatcccagcaacgtattgtccgccgtgggcccaaaaatcccgttctaaacgcatatgttgattaaaccgtgtcactaacgccgcctgtttttcagcttgtcgcaaatagtgttgataagcctgttgtacgcccttgcgaggatcggcttgagccgcggctagaagcgctgccgttggttggtcagccagtagccgtttaaaatccgcaatcgttcgttcaggcatcgggttgatcccccgttaagtcgagcgtaaaacgaccgagccggcccttgcgaatatctaagaggaaggccacgcagaaacgttcccagtcatcgcgcatccccgcatttttcgtcatcgcaatcagtaattccggatttggtaaggccaactgctcagccgtcaaatgataacgatcgactaagcgtgccgcgtagtgctgcttgaagaagtccaaggcaaacaaagcgacgtcatcgttaggatagatattttccttaatcgcacccgtgacggccagcttggtaccaacgacttggtcttcaaacttcggccataaaatccctggggtgtcgagtaattccaatttattggacgctttgagccactgttggcccttggtaacgcccggacgatcaccgactttggcaatttttttattgacaatatggtttaataaggtcgatttaccaacgttggggataccgacacaaactgcgcggattggccgattagtaatgccacgggccgcaatttttgctaacttgtcagctaacatgtcactagccgcttgcgtcatttgcttaccaatcgtacggctacgtgaatcgaccgcgatcgcaacttgaccctggtcttcgtaatacttgacccagtcagctgtcgcttggggatctgccaagtccttcttggtcataattaagaggtgtggtttttgttggaccgttttttcaatttctggattccgggaagccactgggatccgggcgtcgaccaattcaaaaacaatatcaactaaatgtaaattgtcctgaatttgatgaatcgccttggccatgtgacctgggtaccattgaatatttgccattacgttgtgctcctttttctcgtggcgtgaatgccttcaaactttgatcattgttaaaattcttgagcagcactggctgtcaagccgatgctgctagctccagtggcgacatgcttaagtgctttgcaccaaccgccactaatgcactcgttcaacgaaatcgttggtcgctatgccgcccatgaactaaaacaccggacacttgctagtccgggactggcatgatgcagcaatctatattttaccatgtttacatcgaccatgcttcgaaaccgcccattgatctgctgcccaatacatccgcacgttaatttagctaaccggaacatcgacaccattttattggctgcaggcttgcggtagctgtcaattagctcgttagtcaaagcacatcgcatatcacccttagcgtttcattaataatacccgccgatacaatcatacacacagttcacccactacaaatacaaacaagcgcgacgtcacagccctcatcatcaagatggccgcaacatcgcgcttgtttgattgtcgtttgatagccgtcagctaactaactgacgtgacttaatcccagaatttagctgcaatcttttgtccctgatcaatctttgcccactgctgagccgccgttaactcgttacctgagtcacacgaagcgaagccgcattgatgagataaatataactggttcttattcaaaatttgactagcttgcgtcagtaaccgtaacgcgcgatcttcatcatctaaggtattggtcttactggataacaggcccaagacgacttccacattcggccggtcctcaagtaccttgagcgctgaaagatcaccggcgcggtcatcgtcccattcaaggaagaaacggtcgtagtgttggtcatgcaggaatttcttagcaatcgtattgtaactaccttctgcaaagtgccgactttcatagttaccacgacaattatgcgtccaaactttcaaccctaattgatggccaaaatcaactaactcattattggtgttgacggccacatcagctaattcttggagactgccatttccagcaccaaagggactttgctgattatcactggcaaacacttcccacaagcagtcatcgaattggatgattttgccacccgcagcttgataatccgttaagaattctttatacgccccgagcaagcctgcatgcaagtcatcaacagttttgtaaatctggtcagggccatatagcttatcgatgtatccaaactcaacaaaggcgtgtgcgggactccagatcgttaatttaacgtcattaccatcggcttgtgacttaagttgctgataaatatcgataaaatgatgatgcttgccagacagtggtgctgtgatttcaatgccaatatctttacgtgtttcaaaatcactgccgtcatgatcgcgaaaattataaccttcatccgcaatgaaccgccgaacaccactaaacccccaaataaaatccaaatgccacattgacttcgtatattcgccatccgttagcacatcaatcccatgcgccttttcggtggcaatcaccgtcttcactgccgctgtttcggcagcctggtagcccggcaaagcctcataaaatgggtattgaatatcgtcacgatgttcgatttgatttttataagtaagtaaactagccgggcgtaagagtgagccgaccaattggaaatgtgtttttgtcataatgtaatcatcctccgtgtctgtcttaatgagtttattataacaatctgattagaaaatagataagactgattgcattgatgatataataggcaatacctataacttaaataatttattcaatcacgccagctacaatcatgcgttaactagatactgaaacccaccatttctcaggaggtgcacttaatgcgtattcaacaattgcgctacttagaaaaaattgccacgactggctcgatcaacgaggcggccaaacagttatttatcagccaaccctcattatcccaagcaatgaaagaactcgaaaaggaatatcaagtacaactgttttatcgtcataaaacggggatcactttgacggatgcgggccgtgaattcattaactattctcgcagtgtcctcgaccaagttaatttactcaacgaacattttggtcagggaaccgttcgcaaacgtatctttagtgtctctgcgcaacactatgcgtttgtcgtgaacgcctttgtcgaattagtcaaggaaattggtggcgatacctatcagttcacattacgcgagactgaaacggccaacgtgctcaatgacgttcagactttgaaaagcgagctcggcgtcatttatcttaataagttcaatcagaccgtgcttagccgtttgattgctgacaaagacttaagcttcgtaccgctattcgaggctcgcccgcacgttttcgtcggtcgtgataacccattaacgcacaagcaagaactgactttggatgacctacgagactatccctacctctcttatgagcaaggcgatacgagttccttttattttgcagaagaaatcctcagtacgctgcctcataaaaagcatatccgcatcagtgaccgggcaacgatcttcaacttgatggtgggtttaaatggctatacaatcagttcaggcatcatcagcagcgaactcaatgacgaaaaaattgtggcgattccactaaaagtggatgatgcaatgacccttggatacctgcgccataagaaaatcgaattgagcgctacggcccagcgctatttgacactattgaaacagcacattcaaggatatggctttgacgtttttaataataattgactgatcgacacatgacgtgactgaattcattttttgttaacaacatacagtggcgggttgttttttgcaatttgatcaaggctttaatgtccaaaccgcaatcgccttcactaaagcaggacacctaaaccatttaaacatcatatatatcctttttcaaaacccccgctgagtatggattaactcagcggggatatcagtttttttatcttaatttattgatgagatttcaacacactcaaaattcaatcaatcttgttcataataatatgcatttaaagtatatgttttaataggggtaatctgtaattcatatttttcaactaaatcagctaactcctgaccatcaattagtgttaccgtattatttccctgcatcgccttagctttagctcggttagtgaaatgactagttgtcacaaagataccatattcagcattaaaactatccatgacgcccttaaatttatcaatttcaggttcggatacctggtcctgcgtataccgtttgcactgtattgccacccggctagtacgaaactcgtcggatttaaaatagccaaagccatcgataccgtgatcagctgaacgtaccacaccacgatttttatcaatggtcacacccatttttgaaatcaatgctcgcgaaaagttttcaaactttccagaattgaatttttttaaacattcaattaaatcactcttccattgtgattcatctgcatcttgtcgcgactctggatcatcgattacgaccagatcctcatccctatctgccaacttgtcatcagattcctgcattgctgttaatttccgatgtactctttcacgtgtcttttgattccaatagttcgtaactagttgggtttgttcagaggtcggataatttgataattcagcagttctgccgatacttgtcagtgaaatttcctttccccattccatggaactaatatagccaactgtaagtaggttttttaacccaaagttgaaatcgtataggaagggattatacgctcttccggtccgtgcactgactttagtatcatagacatcctcatacttcagattaacatattcatttgtagcaattgtctggcgtattatttttcgtgaggctgttccaccaagttcccgtagtgctaaaacgattgccttctctacattccaacgcttataactcatctcaaatgccaactttcaaatttaatgccaactattttttgacacagcaaactgtcaatattcggcttcaaaatttattctatcatgtttgaattagtcttgcgttgtgcgtttccccatctaaccaactaagatcacgaaaaaatacgacattcgggttgaatgccgcattttagtttggtttagctacttgtttgtttcaacatccaatgcatgtttggccgcaagcgcacgaccaaaatcagtttcatcaaaatgatcaatgatttgctgaagcgcggtcgcacttaaactggccccaaataacggactgccgggttcagtcataataccatccgccagtcggggatagctaatgggatcaaacccaagcgtctccacaaagtgggccacagttgctacggcttggggctcatcaccagctaccaatagggccttccgcgccggatcgccattaggtctggcgtcttcttgcagattatgataacccatatggttcagtgttttaaccagatggctccctttgaagtattgctggacttgttcgctggaggacgtctggggatccagaacttcttcccgtaccccgtctgtttcccaccaataattcatagcgtcaattacaagtttgccatcaagcgccgtagccgggatttgccggtaacgactcagcggtaatgctaaaataattaactcactgttggcgatgacatcctgattttccgacgcaattgcacccggaactagtgtttgaatcgttagttcaattttgcttactttgccagagcccgaaatgcgaacgtcatacccggccgccaatgccagttccgctaagacgataccaactttaccggcgccgaggattccaacgtttttgactgtcatttggtcgtcacctgcttcgcttgtaaaatagttttaacttgtggaatcacctgtgtcgcatacaattcaatcatccgttcacgttgagccgccgtttgattaccggccccgtataccaagtcaaagcgccccagccctagtgtttcaatcgtcgtcgcgatccgttgcgcaaccacggtcggcgttccaacataaaacgacccgtattttgtttcacggtcaaattgttcgtgactcattggcgcccatccccgggtcaatccaatgcgatcaaaattagctttgatattttgataagccaccgtcaaggcctcatcctgatcatccgcaatgaatccatgcgaatgcaccgcaatcggataagctggctgattgaactttttagcggcttcgtgatacagtttgatatacggtttaaatcggtccgcccggccaccgatgattgcaatgatgactttatagccaatcttagccgcgcgaataattgattctggtgaaccaccaatcccaatgtaagtctcaagttcaccagtagctgtctttggatacacgtcttgattcgttaacgaagcccgaaacttacccgaccaagtcaccggcttttccgttcgcaattggtcatatagtgcgagtttttcgttaaataggtcatcataatccgtcaaatcatagccaaataacgggaacgattcggtaaacgacccccgtcctaacatcacttgggcgcgcccattagacaggccgtctaacgttgcaaaccgttcataaactcgaaccgggtcatcggaactcagcaccgttactgctgacgctaatttgatgtgctgggtcacggcagcggtggctgctaacaccgtttccggacttgagacactgtagtctggtcggtgatgttcaccaatgccaaaaacatccagcccatactgatccgctaactgaccttcgcgcacgatttggcgcaatgactctcccgccgactgtaaactaccatccgttttcgccacaatatccccaaatgtttctaacccaaactctagttgattaacatcaatcatcttaatgcccccattacttttattttacttacttttagtaagtggttgatgttaatatatcgtattatctctttaaatgcaactgataggcacagcttgacagtcaccttcaatcatgattaaaacaatctgccaattggatgaattccggttcggtagtaattcagcgatacaagcatcgcacagaataaaaagaggtattcaattagaatacctctccgtaactcatccgtaagttgttccgaaccaatcatcattgcaaaaatcaagtttgcacatgctatctagctctgggcctgccgttgcgtctcatgacgttgtgcccataagttgatcactaaagcgacaatcattaatccgaacgcaacaatcatgatattttgtagtccagtgtgtaagatgccacgcatcatcggcactaggtgcgctggtagccggcccgcccgactagcatcacttaactggttcatcatcgccatggtgattttaccatccgatcgtgccaccccactagtcagagcttggttcatgattagcccaaagatagccgtggtaaacgtctggctgagcatccgaatcaaataactaaacgaagtcgcaactggaatgtcacgttgatcagcgtctacttggaccttaacctgcagctcattaaagcaggccccattgccccaaccttcaaagaagccagctaagagtaagacccagtatggaagcttaacaccgccaatcatcaatggaacgaaggtcagcgtcaaaatgataatattgatcgtcaagacgcgatggggcgtcaagtgccgccgcatgcggggaactgattcactacccccaaaattagcaaaagcacttggaatctgcgtggctcccccaattaacgctgacgtccctagcaagccctgagcccacatcggactgtacgtcaaaaaggcaacgaacgcgccccaaataagcacaaataagacgaaatcgaccactaacggcgcgttcttaaacaggcggcccggaataaccgggtccacagcgcgacgttccacgatggttaaactgcccaacacaatgagcgcccccacgatcacgatcgcgacaatccataacgacaccatgccgatcagttcaataccaccaagcaaactgatgatcccaaccgccatcaataacgcccctgcacgatccattggttgcaagttatgttcccgcttaggttcttgatagaagatttgtaacagcacggctgagacaatcccaattggtacgttgaggtaaaagatccagtgccaagaccacacatcgacaatcacaccaccgaccatggggccaataatcgttgccatactaaagcaagccgagactagtcccagtgcccgcattcgatcacgcggattcttaaaaatgtccgcatacatgatgtaaggtaaggaaatcatccccccgttgccgagacccgcaacaccccgagcaataatcaaaaaccagatgttgggtgctaatccttgtagtaaggagccgacaataaagagtgccgtcgtcatttgataagctcgcttattaccaaagcgctcacccatttttgaccagatcaaggtcgaaactgccgttcctagtaagaaaacagcgacgatccacgccattaaccgtagaccgtgtaaatccgcaataattgctggtagcgccgtattcacattcgtactatcgataccagccataacgttcgatagtaacagggcgccctgaacaaaataaatggcccgtcgattcacaacaaaacttctttctataattgctaaacatctcgtcagtcgttcagctaaaagttacctcaatccaacccgttgaaattcactatttcatactgatcaattaacgcacaatttctagtataccgctttacccccaccgcaaggcaagtctaaatcttgatttaaattcatgatgaacaagactttccactgccgatttataaagcacccgtgacaagccatttttgagcctaattcgtagatccacctctatcttgtcaaagcttcgttgacggtaccgcattaaaattccgcaactaaaaaggcataaccgaaagccatgcggatttcggttacgccttttaaaatatacgaatcagctttgaactaatttgtcttttcaatcaatttcattgctgcatcgtaagcccgatcattatcactgatcttattagctaattcagtctcgatcttagtcagtgtctgtttatcgaccttgccattgaccgttaacttggcatgcttttgatactgcttgaccgcactggtggttgaatcaccaaagtagccattaacggttcctttaaagtaacctaaggcttgcaagtacttctggaacgtcttgacattgctattgaccttgtcagcttgtaaatcactgaccttgctaataaccgtcaagcttgcataactcggctcatcagctttaacatcaggtgtcaagcccttcttgttgatccaagtgccgtttggtgtcagccacttcgcgaccgtgatcttcatctcagtcttatcattaaaagtcgtcaccgtttgaacggtccccttaccatatgactgtgacccgaccagtttaacacctgccgattgatgcaaggctgcggagaagatttcagctgccgaagcactcccaccatcaattaagacggtcgttggcttcgtttctttaaagccaccatcatacttcttggacgccgtgtatttttcggtcgaaccatcgcgtgcttggacctgcatgatcgtcttaccattcttcaagaagattgaggccatcttcaaggcagccgtcatcaacccgccaggattaccacgcatatcgatgactaacttcttggcccccttcttatcgagtgccttcaacgccgtcttaaattccttagcagtattcgtcgagaaggtcgataccgtaatataaccgatcttcttatcgccaccgactaacttataatcaacggtcgtcactggaatcttagcccgcttcaaacttacggtaaaggtttgaccactgcgttcaatcgtcaatttgaccgtcgtaccgatcttaccacgcatcatgctaacggcttgtgtcaaggtcttaccggccactgacttgccattgaccgccttaataatgtccttcggtttcaaaccagctttcttagctggcgtaccagcaattggtgaaataatttgaacatagttgccagatttttgaacctgggcaccaattccagaaaacgaactgtcgatcgtgtcattcaagctttccgtctcgctcttgtccatgtactcggaaaatttatcacctaacgaattgaccatgccgttaatggcaccgttggccaacttattcgcattgaccggtttgtagtaattctcattgatcgtttcataaactgattcaatctttttcattgctttactagtctgctgcatactgctgagctgggcattgacttgccgaccaatcagccagtacgtcccacccaccccaatgcctaatgcgacgacaatggaaataacataggtccatagaccaacgcgtcgctttggccggggcactttttttatgtgcggattagtttgtttgggttcctctggcataccgaacgtcctctttcctacaaattaatttaagcttcacttgccaaataggcttgccacgcgtcatcaaagaccgtcatcgttggcaaataaccagcgttcaattccaaatattgtgagagttcgtgaaaatctttactctgctttggaaacgattgatccaaaaacgcattattggcaaattcggcaatggcatcggtactgtctgggttccgttgcgtcatcaagaatgtataaaatgttttatgcatgaattcactccttagtcactagtttttggaatatgcatttcgaacttgaactgattattcttcaaatcaagcttatctacactataacgaacatcatgtttaccaactaatttattcaagtagaggtcgattgtcttcttcttggcattcaacttgacccacttaggtgtcttgtaattattattaatataattaatcacaaagctgattggcaaggacatcgtcccgaccgataaattggttgctttcaacgaaatattgccgttatcgatgacacttggttgcatcgtgatcacaaacgacacgttctgacccagtacctgcgtcgttccgagcaaataagcgccggtagaccggaccacgaagcgatatttcatgtcttggcccttttgtagatcattcaaataataactcgcaagggcgtttaattgttttcgattcattgtaatcggcacactagccgcatccgtattgcttgcagccgtcaaactagtgctttcgctaggcgatcgtaagacctgggtgccgacgtaagcaccggtgccgacaatcaacgcaatcaagacaacggcgacccatttccaaacattgattggaccgtttgtcttcggatttttaggtgctgatgcctgcttgtttcgttgtgcttcccgcatctcattacctccctattttttgattaaccacgcatcatgggccatcatggtctgatacagtttggttgtaaacacacgatacccccgcttattgggatggaaattatcagcagtcgaaatcaaatcattcgtcttgttttccgcctctaaagcgccagtaatggcctttgagctggttaagctagttaaggtcgtggcactcgctgctttcttcaacttgcgaatctgggctgccgtcttgtactggccgtgtgacatggtccaattgatatccataaaatacgtatgcttgtattgactaaccgtcgtctgtgtctgatcattccactggctaatgtagtgcgtgatcgacgtcacatttggaaagttcacataaattggattatagatgctaaagacaaaaactgacgcagtgccattcaaactttgtaatttattaaataatttagttagtttattcgcatataaagtttgcgctttagcaaccgtcgcgttatttttggccgtattgttagaagttagggacccttcgagcgtttgcaagaggtcgttaccgccaaccgtcacggtaatcacatccgccttggcaattttctgttgtaacactttcgacttattaatgcgtgctaaaatctggtcactccgatcaccggacttaccagcattcgtggtcgtcaccttcagcttttgcttagtcgtcaacgtttttttgatctgaccaacgtagccaccctcggactcatcgccgaccccttcggttaaggagtcaccgaccgcgaccaagttgattttcgccttgtggggcgtcttcttggcagtggtctttttagtcgttgttggggtagtcgtcgccgattcattttgcggatgcagcagataattgaccccgaaaaacaccccgaccgctaacaccgccatcactaaaatgattttaatggtttctttaactttggacattggcatccaacctttcttcaccgttgagcagtccatttaatcagagctaactcatctttgaacaataaaatggtcaccatcccctgttgggacgatcaccatttgccattagtgctcgtagacaagtcgcctgtgggacaccgctcactttacgctggcgcttgcgtatgatattccacggcaaacgcacccgggccaccatgggtcgcaataattggcaccgttggttgaacactgatcttgagacttggtaaagccgcttgtaggcgcgcccgatattcttccacgcgctccgtggcgccaacgtgagagattgcaacttcggcgacgttcggcgttgcaataatatcgtcgagaaccttatcaaaaaacttattaatcgccttaacaccgcgccccttcatcttcacatctagggtgccgtcatcaacttccaaggcaatcttaacattcagtagcgtactgattgcccccgtcagacgactgattcgaccaccagcaacgaggttattcagggtcattacgcccatgaatagcttggtatgggcctgagtcgcatgaatctgatcgatgaccgcctgtttgtcagcaccactctgggctaacttagcagcagtcaaaacttgaaaggccatcgcacggtcggtcgtccgagcgtcgatcacggtgacatcggtcttcgtaatcgaagccgcttgttccgccgtgtgcactgttcctgaaatggcttcgagcatattgatacaaatcacactcgcgccatccgcacctaacttatcaaacgtttcaatgaacgttccgagtgccggttggctcgtctttggtaaagatttagccgttgccatcttgtcaataaattcttcacgcgtaatcgtttcatcttccacgtaaatggtgccatcgatcatgacagtcaacggaatcacggtaatatcgtatttttttacctcggcatccgtcaaatttgccgaagaatcggtcacaatcttgattttcgtcatactttgccacgctttcttatacttgtaacgtttaaacgatcgttacaataaaattaatgctttcagtatagcagaaatctgcctgagtttcacggttgccactgaattaacgacggcggaaatcatcaaattcgtacggatattgatttttctcatccaccgtcccaatttgttggctcaccagctgccactgcgtgtaatctacggccggcatccaagtatcaccatcaaaccttgcgttgatacgcgtccgatataaataatcggccaccggtaacacggcttcaaacaccaccgcaccaccaatgacaaaaatcggttcatccggatgggcggccgcgagtgtttggatcgccgccacatctgctagttgatggacttccggtggcaactttaaatcagactgacgtgagagcacccaattggtccgccgtgggagcgggcgtttaaagcccgcaaaagtcttgcgccccatcacgacatggtgtccggtcgtcagcgctttgaaccgctgcatatctgctggtaaatgccagggaagctggccctggttgccaatcaggccattttgatcttctgcccatatcaatgcaatcattgcggcctcctaaatcgcgaccggcgctttgattgccggtgcgggatcatagccactgagcttaatgtcactcatttggtaatcaaaaatactgtcatgagccccacttaaagtcagctggggtgccggccgaggttgccgggtcaactgcgttttaacttgttccacatggttagtataaatgtgcgcgtcacccaacgtatgcacgaactcgcccactgctaggcccgtctccttagcaatcagatgtgttagtaacgcataactcgcaatattgaatggcacacctaggaagacatcgcctgaacgttggtagagttggcaagagagcttaccatccgcgacatagaattgaaacagagtatgacacggtggtaacgccatgttcggcacatcttctggattccaagcggaaacgattaaccgccgcgaatccggatgcgtcttgatcatttcaatcacattggcaatttgatcgatcgtctttccctgacgcgtttgccagtgacgccattgcgcaccgtaaacgtcacccaaattaccatacttggccgcaaacgcgtcgtctgtcaagatctggtcatcaaaggtctgcatctgagcttgataaatcggcgcaaagtcaggatcatctagccggcggtgttcaaaattcgtcatatcagggccgtcataatcggcactcgtaacccaatttttgaacgcccattcgtcccagatatggttgtgatgttgcaataaatactgaatattcgtatcaccatgcaaaaaccatagtaattcgctcttgatcagtccaaagggaacttttttggtcgtcaataacgggaagccttgactcaggtcaaagcgcatctggtaaccaaacacactgtatgttcccgtgccggtacggtcatccttatacgtgccgtgttctaaaatggtgcgcgcgagttgtaaataactatcttctaacatgcgatcatcctttcaggcttctgcatactggctgaggtagtcccagcgatccatcttctcatcaatcgtttgttccgtcttagtcaattctttttgcaaatcagccaacttgccataatcactggcattggcagccatcgccgcttcgatctcactcttatggctatccaattgctcgataaccccttcgatcttgtcgtattcgagctgttccgcgtaagtcagcttgactttggctttcttggccaatggtgcggtcgagtcatccgtgaccggcttagccgtagtttttgtcgcagtggccttggctgcgggcttggccgcgtctttttgatccttcaaataactggagaaacggccagaatagcgttcaatatgcccctgaccatcaaaaatcagtagtttcgtgccgaccttgtccaaaaaatagcggtcatgggaaacagtgatgacggtcccggcaaaatcatcgaggtagttctccaacaccgttaacgtaccaatatccaaatcattagtcggttcgtccaataagaggacgttcggctgttgcatcaacaacttcagtaagtatagccggcgctgttcgcccccagataacttgcgaatcagcgtgccgtgcatcgaacgtgggaacagaaactcttctagtaactcagtcactgaaacatgctcgccctgcttattcaagaccgtctcaccgacatcttgcaagtaattaatgatgcgcttgtcgcccggaatcggttcggtctgttgagtataataggccatcttgacggtctcaccgatcgtcacggtcccactatcaagtggcagtcgacccgcaatcacattcaataaactagatttcccggcaccgttgattccagtgataccgatgcggtcattggcttggatcaacatcgaaaagtgatccaggatggtttgccgatcaaactgcaagctcgcgtcctttaactcgatcactttcttacccaaacgctgctgaccgagcgaaatatcaacatcgttatcaacttggagcgtattcaaattatccttcaaatcattgaaccgattgatgcgcccctgttgcttcgtgctacgcgcgggtgctcccgcacgcatccaagccagttcctttttgtacagctgctgttgcttatgttcagctaacacgtcacgggcgacccgttcggctttcgcttgcacgaaatcttggtaatttcccgtatacttatgcagctcgccaaatgacaattcaaacatctggttggcgacttgatccaagaaataccggtcatgggtcacgacaatcaaagcacccttataactagctaaatagctttctaaccactcaattgagtcaaaatcaagatggttggtcggttcgtctagtaataaaagatccggtgattgaatcaacacttgcgccaggcccacccgcttctgttggccccccgacatctgactgacggtctgcgtcaggtcggtaatgtgcagttgtgtcaaaatcgttttgacatcactttcagccgtccaagcatcttcttggttcattcgatcctcagcggccacgtaagctttttgggtcgcttggtcttcgggatgatcagcataagcggccaacgtttgctcgtagtggcgaatcgttcgaaagacttgctgactaccggccaaaacggcatcaatgactgtcagattctggtcaagttccggcttttgctttaaataaccaatcgtataatttttgggcatcaccagttgaccggcttccggtgccgtaatcccggctaatacgtctaataaattcgttttcccggacccgttaacgccaatgacaccaatccggtcatgttcattcacaataaatgaaatatcgtgaaataacgtcttctcaccataagttcgggtcagattttctgctcttaaagtttgcattgttacgatccaccctttttttacatcattaagttctatcttagctagaatcggcttaaaacacaactgacaaacgcgcaaatcaacgttaatatttcctaacgatcatcgattcgattgggtcgtgagtcacaaaaaaactcctgaggctcactcggccccaagagttgtttggcaacaccttattagttatgatcaccataaacatcaaagacggtccgttcatcatcaacgactaagtgtaattttccatcgctggctaatgagctcgtctgataaatgttgtcgataccatccgcatcccgtggcttgaatggcaagtaaatttgttcactaccacgttcgtcgccaaacaggatatcaattttttcaatgtcttgataatgtgtcacccgttcaaacatcccacttgtcacggatgatagttgggtcgtgtccggatcgatcgcatcagcgtcaggtttaaattcagccttaaatgatttacaaggatgaatgatggtcatatggccacccttaattcgaccgtaactcgtcgttacccggccgatccacaggtcagagatatcttgatgatgaactgtccaagtgtcaccattccgaaaatgaaatttcaatgcttctaatgctcgttccattcaaatcacctcattgaattagtttcactttaatcgtaacagattcatagaaaatatcaatggttttttgaatccgctaccatccttgcaaaatcaagcaaagcatcctgctgatttgggacctgtttcatcaccacggcctgtaagcaagccgctagaatttgacccatcattggcccaggcgtcaccaatttagctttcaataaatcgccaccgttaatggccaattcatgcttgtcatggattggtaagctagcataagattgcaccaattgtgcttggccctggccaaagcctaaaatcgtagccacctgattagccgttttcagcgcctctaagcccgtataaaagttctcctgcgcagttaactgaccgttgtgttttaacgccatcagcgctttaatagcggccgtcacgtgattaatcagctcattgctcgtcttccacgtctttaacaactggcgaacagccgcttcgtcagtccgttgcatggtccagctaagcaaggtccaagtactttcaatactcggcaaatgccaagctggaagtgccattaactgccgcagcatcgcttcttgatcagccattgcgggcatataacgatacaagtcagtggtcagcaagccggtcaaaccagcaactgggtgctgacccatcagcagcttctcccactcgacacgcgtccgttccacggcaattttcgtcaacaacgccgcattatcggcaatcgcttgttcggtctgcgattcaatggtaaagcctaactgacttgcaaaccgaacggcacgcatcatccgcaacgcatcttcgtgaaaccgttcttcagccactccaacggcgcgtaagattccttgttccatatctgctaacccgtcaaacagatcaatcacttcaccgttagcagtcatggctaaggcgttgattgtgaaatcccggcgcttcaggtcctctttcaatgatcggacgaacgtaacctgatcagggcggcgaaaatcttggtaaccagattcagtccgaaacgtcgtcgtttcataaccattgccgtgatctaagatcatcaccgttccgtgctcgattcccgtatcaaccgtccgtttaaataattgtttgacttcagccggaaacgcgctggtcgcaatatcgacgtcatgtaggggcttgcccaaaatcgtatcgcgaacacacccaccaacaaagtacgcctcatagccggccgcttcgatcgtctcaataatcggcttagctgcttgaaactcagctggcaactgcgtcaaaatcatagtaagtgctccaaaccaacaaagagttcgtgatactggttaactttttcaaccgccactttgacaccagtcataaatgagatccgatcaaaggaatcttggcgaatcgttaacccttcaccagggccgccaaacatgacctcttcgtgcgccactagtccaggtaaccgaaccgcgtgaatccgcatcccttcatattcggcaccccgtgcgccaggtagagtttcagttgcgtcaggattaccttgttcctttggttgccgaacttcagcaatcttcttagcagtactgatagcagtaccacttggcgagtcaatcttatcgtcatgatgcatctcgataatttcaacatctgggaagtacttcgctgcttgttgggcaaattgcatgagtaagacggcactgatcccaaagttaggcgcaatgaggccgcccacttgcttgtcctttgctaatttttgcaactcggcaacttgttcatcggtcatcccagtagtcccaataacaggcgaaataccatggttaagtgcaaactttgcattttcataaacggcggttggaatcgtaaagtcgatccagaccgtggcatccgtcttaatttggtctaaatcatgaaaagctggcacgtcttgacccttaaagcggtcgtcctcacctagattttgttctccactgcgcgcgtcatagaccccaattaattcaaaatcaggattatcaatgaccatctgagcagccgtactacccatccgacccttatagccggcaacaattacttttaccacaataaattcctcctcaagattaagctaattatattttagcagacaattgccaaattaggcaggagaatcctcgctgaacctgtttaaactgttaaactagccccattttgttcatgaccaatggctaaaacggtcccgctaattaacttgctactttgtgggacgagccacgtccgtcctataacactgatatgaataaaaaatagtgtctgactcaaagcgtagtcccgctcggtcgaacactatttgcttatatatttcggccgccaacaatacctggtgacgctaaattaacgtgtcaatcgtcgctaacaccccatcatgattattgtcatgtgacgtaagatacgtagccatctctttgacgggtgtaatcgcattttgcatcgcaaaactgtaatcagcctcccgtagcatttcaagatcattaccgttatcaccgaacgcggccgtttgactaggggcaacgtgccaatgctgctggagataagcaagcccggttgccttgttaacatgtggtggaatgacgtcaagcccattaccaccgctgacagtcgcacgtaaccggccagcaaattgctgattgatcaaagcggcgtgcgcatcagcatccgtggcttgccaactaaaagtcgctttatagatatggtcatcaattgctgatagcgatggcaccacttgcagccggctcaaatagtaccgcatgattggactgtcatcttggggccgaatatatgccccttgcttgccggagaccgagatctcagcaccagccagtgctggttcagtcgccacgtaaactaacagttcctgataaagcgccggctcaatcaagctttcagccaacacgttgccgtgattatcaatgactaacccgccattttcagccacataggtcaattcaccgttgatcccgtcaaaaacatcaatacaatgttgcagctgattgccgctcgccacaacaaagtgctggccctgagcattcatttgatccaactgggcctgaaaccgatggtgatcaaactgatggtcgtctctcaaaaacgtgccatctaaatcggtggcaataatagctactttcacgatagtaaacgcctcacttaaatttggtatacgttcattttaccaaaattgaaagtggtttcaataactttagaaatgaaacctctcagcaaacggcgaagaactaaaggcctagtagccctgatcctcgtagtcttctagcatcgcaaccatttcaccatcatctggttcaatcgttagataattccgcaacgctaccacggcactgtcggccattcctgcttcgcggaagaaataaattgctggcttaaggaaatccttgttatgttcaaagaacggataagccgcttcgtaattatccttagccgcctgaaaatgatcgagccggtcattagagattgccaagttccagtagaactgtggatcaaactcattactttgcaaatattgatccaacaagtcgatattgtcttgataacggtcccgctgaactaacaaattagacagttccagtaccgtagtcaaattatcagggtcaatactcaagccttcccgtaaatacttttcagctaattcctgatcgtctaatttcaaggctaagcgggcagtttgcaagtacagctgctcattgtattggtcgaccgctaaaccttcttgtaaggtcaataacgccttgtccagttgatgaagttgctcttgggcctgggccaagtatggatacagggacgcatactgattgtcttgttcccgcagtttgtcgaagatatcaacagccttctggggttcgtttaattgcaaataagtgaagcctaattcaaactggctgtccggcgtgagcttggcaggcttgatttgttctaaataacccaccgcctgctcaaagcgcccggactcagcataagccacccctagtcgttcaactaagttaactttagagatctctagttgtccctgcttgatcaagtccaagtagaagcgagtcgcctgaccgtagttacgaatcaagaagtaaaattctgcgagcgcaaattcgacaactggttcgtccggtgccagctgataggcttccttgagtttttgctcactgacttcaaataactcttgggtctggtatagatcggcctcaactaacaacgcttgaacgtatgccggtgagtctggcttaacttgttgtaaatagtcgagtgccaggtccgtatcgtcctcatcgatggcaatatcagccagacttgtccgtaagtcgtcctcatcgggatacttagccagtaacttcttataagtccgttccgcttgctttaaaaagcccaaaccgtacaattcttcagccagactatacagcgtctggtcatcgtccttacgtaaggcccatgcaaagtgctttttggccgtgtcaatttgcccgtttgatagtgctgcgagcattttttctgaataactcattacacccatcctttaaaccactaagaaacgacttcatttagtcgccatggtttcatcatttatttcaatagtcagcctgatatcgtcacatgggataccagctgttaatcgcttgacctgacagtctatcataccgcagacgacagcaaaaaagccagtataacggtcgctatactggctttcatgtttgcatttcattaactgatatgcattatttaactgcgtcctttaaagctttccctggcttaaatgcaggtactttgcttgcaggaatttggatttcgtcaccagtttgtgggttacggcccttacgagctgcacgttcacgtacttcaaagttaccaaatccgatcagttgaactttttcaccctttgcaagagtgtcttggattgatgcaaagactgcgtcaactgcagcagttgcgtctttcttcgttaagttagttgccgcagcaacgttgttaactaattcagctttgtttgccatgtttgattcacctccccgttacagagtgaaggatcgccgtgctttttaacatcgttgatccagatgatcatttttgagtggtccaaaaatgagagaaacgataacaagcatcatttcttcatcaaagatagcataggaatgctgtaatagcaagcttttttagccttttcagcgaaaatagcgcaaaaagatgataatcgtttacatcaatcaaataatgtgctaaaatgctgattttacgcgctttagcctacttacgtcgccgttcgatcatgtggatcggcgtaccactaaaatcaaaggcattccgaatttgattttcaaggaaccgttcatatgaaaagtgcatcatatcagggtcattcacaaagaccacaaaagttgggggttgaatcgccacctgagtggcatagtaaacccgtagccgcttaccattgtcactcggtgtcggattcatcgcaatcgcatccataataacgtcatttaaaacggacgactgaatccgccgcatatggttcgtattgactttcttaatcaacgcgggtagttgctccaaacgttgattagtcttagcagagacaaaaataatcggcgcatagctcaagtaaacgaactgatcacgaatatacgcttcgaattcttgcatggtgtggttgtctttcttaaccagatcccacttattgaccacgatgataatacccttacccgcttcatgcgcataaccagcaacccgcttatcctgctcacgaatgccttcttcaccattgatgacaaagagtgccacgtcactattatcgattgccttgagcgcacgcataacgctataacgttcggtattttcgtaaacttttccttttttacggataccggccgtatcgaccatcacaaaccggtcaccatcctgatcagtaaacttggtatcaatggcatcccgggttgtcccggccacgtcagaaacgatgacccggtcttcacccagcaaggcgttgacaattgatgacttacccacgttcgggcggccaatcaaactgaaacgaatcgtccccggttcgtcctccccacttttttcaggaaagtttttgataacagcatcgagcaagtccccaagtccgagtccatgcgcacctgagatagggtacggatcgccaaagccaagggaataaaagtcatagacttcactccgaagttcaggattatcgactttattaacacccagcacgaccggtttgttcgaccggtacaagatttgggcaacgtgttcatcagcgtccgtgacgccttctttgatgctaactaaataaataatgacatcagcttcatcgattgcaatttcggcttgctgtgtaatctgtttaatgaatggggcatcttcgatatcgatcccacccgtatcgatcaaactgaattcttgaccaagccattcactgttggcgtaaatccggtcacgagtcacacccggtgtatcttcaacaatcgagatccgatcacccgcaatccgattaaaaatcgttgatttaccaacgtttggtcgcccaacaatggcgacgactggttttgccatattaattcctcctttaccctcgtagcgtcaggttcctgctacaagtctcaaattaattggtaacaccaactaatctgttcctaaaaaaatatccttcaaggcaagcttgaagggtatttttaatcaatcaatgattagttttcatcattgttgctttcagcattcttcaattcgtcaccgatcaaatcacctaaagtgaaaccagttgattcttcaggagcattagccgttgaacgttcgctagcagtccggttgtcccggttgttgttacgacgacggttattgttactccgacgttctggttgactttcgttgtcatcgtcagcagtttgtggcttttcttccaaagctttaattgataaagctaaccgcttttcgtctggacgaacgtctaagactttgactttgatttcttgaccaacttttaagacatcgtttggtgttgcaatgtgttggtgtgagatttgtgaaatgtgaactaacccttcaacaccagggaagacttccacaaaggcaccaaaactcgtcaaacgcttaactttaccatcaagtacagccccttgtggtgctttttcttcaataccatcccaaggttctggtaaggttgctttgattgataatgaaacccgttcgcggtcagcatcaacggataaaatcttaaccgtgacttcttgaccaaccttcaatacatcagcaggcttttcaacccgttcgtatgagatttctgaaacgtgaaccaaaccatcaatcccgccgaggtcaacaaaggcaccgaagttcgtcaaacgagcaactttaccttcaacgacatcaccagcttgtaaggtcttcaaagcttcttcacgttgtgcttcgcgttgcttttcaacaacggcacggtgtgataagatcaagcgattttcgctaggttcaatttcaataatcttaagttcaagttcttggcctttataggcatttaaatcttcaacataatgatcatcaatcattgaggcagggatgaagccacgaacaccagcgtcaacgactaacccgcccttaacaacttgcgttaccggagctttaatcgtatgacctgcttcgtattctttttcaacatcgtcccaaactttgcgagcttctaaccgacgatgtgacagtaaataactgccgttttccttgtcgctgccaattcgagaaatgacaaccaagtctaatacatcaccgactttagcggcttcgttgacatcgtcaacccgttgtgttgagagttccttcaaaggaacgaccccttcaacaccggtaccttggataccaacaattacttgtttgtcgtcgtcgattgctaagacttcacccttaacaacgtcaccgacgtttacttcttcaacgctgtttaaagcgtctaaaagttcatttttctcttggctgttttcgttttcactcatgcaaatttcctcctgtcaacaataactctaacctatatcatagctgaaaatgcaatgaaaagctagctaaaagcattaagttaatgcaattagattgttgaactttgtttttttgtaataattttggcaatggcagcaacaacttcatcgattgacattggcgtcgtatcaacaagtgtggcgtccgttgcttgtgttaatggtgacactttacgcgttgaatctttgtggtcacgtaattcaatctcagcctgtagctgagccaagggcgtatcgatccctttttttacattttcggcgtatcgacgcttagcccgttcagccgctgaagcaactaaaaagatcttaacttcagcattgggcaataccgttgtcccaatatcacgaccgtccatcacgatcccacctgcattggccatctctcgctgttgttcagttaaaatcgtacgcacctgtggtaacgccgcaatcgtcgagacgttattcgtcacgtctggttggcgtatcgccgccgtaatatcttcctgattagcaaaaaccagttgatccggctcgccgggtttaaaactgatcttgagcgacttcattgccgtaatcacagccgcttcgtctgctaaatcaacgtgctgttgcattgcccagtacgtgactgcccgatacatggcaccagtatccacataaatatagccaaaccgttttgcaacgagtttggctacggtactcttgccagctgaagccggaccatcgatggccacctgtaatgcttgcttagccattaactaacccctcacaatctgaaaaaatcgtgtattaacggacacgtaaccgttgaccagccgaaatcgttgcatcagatgataacccatttaattccaatagcttatccactgagattccagcattcgtagcgacccgatagaccccttgaccggcttctaccgtgacgtacttagtccctgaagatgattctgaggagctactactactgctagcgctgctgtcgtcagtactcgcactttcttccgagctggcagcagtagaactagcagccttggaactggcagctttagagctagccaaggctaagctactacttttagcagccgcctttttcgacgatgcggccgccttcttcttgctagcagcagtcgatgacttactggcagcaacactggccgatgacttcttcgagctcgaactagcaacttgttcagtctgttgcggattattaagcgaattctttttcaccaagaaataaccaattggtgccaaagcaagcaacaatattagtacgactaacacggtcgttagcgtagagttgctactgtcttgttttcgtttttgagttcgcgataaattgcccgagtcatcccgatcgtcttcaaaagttttgtcccacggcttatccgcttgggatttgtcattatcatttttttgactcatagggtgttcctcctcaaaaaactttcaaccaatattgtaacataacccggaattgatttctttaagaatttggtaaaaacaattgagctaagtgctgatcccacgacattatcgtggctgttgactcatcatgcgtcgccatcaaccctaacgcagccagcggtagtggttcaccagccaactgacaacactgatctgtatgggtaacagctggctcaccaaagtaagttaacatcacggtccgatgacaaattgtcgtttggacgtaactcatgagcgcccgcaattctcgttccttagctacttggcgatcagcaaaaatcgttgccacggtcgttgggggagttccttgtagccagtatgactgcaaaaccttactacgatcatcagtcggtggctgctgcgcttgatagcggctataatcttgctgaatttcattgggagtcgcagccgtcaattcgttcaaattccgcaccaggttttcgtcacctggtgcgtacaacataatcgccatcgcctgctgaccatcacgacctgcgcgcccaatttcttgaacatagtcggccaaagtcgtcggtaaatgatagtggatcactaagcgaatatcagctttgttgatacccattccaaaagcagatgtagcacagatcacatccaattgtcctgccatgaactgctgctggatcttgaaacggtcatcagtcgctaagccggcatgataagccgcgacccgtaacgtggttgtcgttcgtagccattccgctatcaaatcagtttgccgcttggaagtaaagtaaacgatgactggtccgcgcgcacttgtcactaaatgttgcaaggtcgcgcgtttactagcttcatcattgacctgttcgactgctaagtaaatattaggacgattaaccgaatataagatttgctgggcatctggaacggttaattgtgtcaaaatatcttgtcgaacgcgttgtgtagccgttgccgtgagcattagcgttgtcggtgcctgtaaccgttgtcgaatttgaccaaggcgacggtagtcagggcgaaaatctggtccccaagttgaaatgcagtgggcctcgtcgataactaataacgccagttgcacttgcatcagcgctgtttgaataatgtcttgacccaacatttccggcgaaatgaacaagaatttaagctgccctaaatgattcaacagatactggcgagcaccataatctagttgggaggtcaaagcagcaacttgcttttcgccttgatagtttaagcgtgccacctgatcttgcatcaaggaaatcagcggtgaaaccaccacaactagcccgggcagtgcggttccaacgagttgatagatcaatgatttgccggtcccagttggtaacactgccaagacatcttgacctgctaataatttctgaatgacggctagctgcccggggcgaaattcatcgaagccatatttcgttttcaacagctcatataattcatcttctgacatgctgacacctcataatctgaaatagccgaaattcaaaaaaatctagcgtgggtagcgcagtttgggcctcttggaatgaccagtttgcaatgtcggactgggctgcaaagatggtggccaactgctgagttaattcatgattcaacaccatttcaaacggaaaatcaggcgaccaaatcgccacctccaacaagtgctcccgtaccgtactcatctttaagtgccgcgtctgcgcaattgctgcaagttgctgggtcttcaagaaagcttggtaagtttgctcagcgctttgactgatggcactcgcttgagtgagcactgacaacaactgggaaaatggatcacgcgggtgtcgctgaatccaagcaatccattggcatatcacgtctgtgtgcatcaagctagcctcccagggttgtcgacctaattgtgccgctaattgctcattagtcagtcccggttcttgataccccgttataccttgaacaaacaccgttggcaactctgggtctgccaaactcgtcaagaaggcagtcaaggccgcatgaatttgctcgccaagttccaccttcgactgctgacgtagccattgtttgacctgggcttgaatccccggatcagtcgtcaccggataataatggcgattatgatgtacgagttcggaaacgacttgtagggctagctgactgacgattctaaatcggcggacatcagtggtttgaaatacttcaaaattttggggcatgtataaagtttgtcggagtttggcttgccgatgttcccccgcctgcgttaattgccagcatcccgtggccgtactcgtcaattgaccgttttcagtcaaagccgcagttgctgccatgaaatcttccaagggaacctcgtggcaactgtcgagcaaatccaagtagccggcagttaaccccgcaaaaagcgtggagaccgtacggcgaccgcgcaagacattgaataggccctttgctcgtcgcggcgtcgtactgaataacaataaaacgtagtctgtaaacacgctaaggcctcccttaagtcttgctattgtaattgttaattgcgcactaaatgtgccagtttttaaattaagtcgtgatcagcccaaatttacgtgcgtcagtgtcgctgacagtgacccgcgacaaagcatagcggccaacagctttttaatctttctaagccttaattgaagcttcaaattcatcaacttactgccacattaaagctcatggataaccatccgccaaccggcagtgtgcgtctttaagaatatcacggtggcaccaatataaaaaggcagtcaccctgcagttacgcaattagtgaccacccacattattttaacgacttagattaaattcggctcataagctgattatggttgcctaaccacttagctaatcgctgatagaccagccagaagacgttgcccactagcaatcccttgatcaagttaaatggaatgactgccactaacaccactgtattcagcgacatgctgagcttcatacccattacttgcaaatagaatggcagaacaaacgttaagttagccaacgattcaatcaccaccaggccgattgtggcgaccacaatcgccacaggcattcgccacttgggattgccccgatagtaacgaagtactaatgcaaatgctaaaatcaatactgccgtacctaaaaaactagcaaaagaaccgattaagtcatagatggcaaagcccatcatggccgaatgtaggagcagtttgatgatagtgatgacaaacgcgcccccgacaccaaagagaaagagcccaatcagaattggtatatctgaaaaatcaatcttcatccatggcgctaccggtaaaatcggaaactccagtaacattaaaatatacgcaatggcaccgagtaaggctatgcccactagtcggtgtaacgttgtatgttgcataacgcaccctcctatgggtcatcttcaatgaaccgcattaccatttgttcaactaaaaaagtccgcccgatcacactaactgtcatctgggggcggacttacttgcaacgcttggcaaataagctcgatcttctttataccagactttactgtcgactttggaattgcaccaaatcactatgcacacgcataggtcgcgggttattaccgccggtcgggaatcacaccctgccctgaagatgaaccaatatttatttttacaaattcattttaacggctttcgttcaaaaatgcaagcgctatcgttcaccttttaacttactaatttcaatcggcttcaatttacggtattcgcccggttgtaagctttgcaaatcgagaaccccataacgttcacgtttcaacttagtcactgggtgacccactgcagccaacatctttttcacttggtggttatgaccctcgtgaatcgttagttggaccagcgcattattcttcttgtgatcactatctaacaagttcgacttcgctggagctgtcttacggccatcgatttcaacacccaagcgcaattgcttgagatcagcattggttggtaccccttcaactttggccaaataagtttttttgacttcgtacttcggatgagttagccgattagcgagagccccatcatttgtcatgatcaacaaacctgaagtatcgtaatccaaacgtcccaccggatagattcgttccggtacgtcttcaaagaagtctaataccgttttacggcccttctcatcatgaacagttgtaacgaccccccgcggcttataaaataaataatacacgagtttttctgcattcaatggcacgccatcaacctcgacatggtcactaggctcaacctttacaccgagcgtggtgaccgtcttcccattcaccttaacgtgaccagacgtgatcaacacttctgatttacgccgcgaagcgatgcccgcttccgccattaccttttgtaatcgttctgccattattcatcctcacgttctgcttgtaatttatcctgaaatgcatttaaaaagaggtctgtctctggtgccggatgctcagcgtcacttaaagcagctaagtcaatcgctggtaagtcatccaaagactttagtccaaaataatctaagaacagttccgtcgttccgtataaaattggtcgtcctggctcacttaaacgccccgtctcggtaactagttgtcgcaaaaccagcttttgaatcgttgacccactgtgtacgccacgaatctcatcaatttcaatccgcgtcaagggttgccgatacgcaatgattgctaacacttccaacgatgcttgcgacaaactcgtggtgagtggtgcttcaaagtagcgctttaacaccggcgccaccgcggccttagttgctaaccggtaagtattcgccgttgataagatcattaaggcactgtctgggtcggcttgatacttcgtggccagttgtgtgagcatcgttgtaatcgccggcttagcaaaccccgtggcgtgctcgatttcggcgaccgtgatgccctcatcgccagccacaaataatagtccttcaatttgttcaatgttcgtcatgctgttcatcctgtcgtaaatataaatgaatcggactcagtggctcagcttgctgcagcgccacttgatcctgcttggttaattctaacacagccataaaggttgtcactaacatttcatcgctggcactaaccgtaaataggtcggcaaaatccagtccttgtggttgatgttgcaattgcgtcgtaatttgtgtcatccgctcatcaatgttgatggtttcagccacaaccgttttcgttagtggccgtacccgccgccgtttagccactaattgccgaaaagccgcttgcagatcatctaatgtaatccccgcagtcagcttgggcgcactcagatcagctggtactaacatcgcttcacgcgtaaaatgttgatggcgcgcctgttctttttctcgcaattcaccagcggcttcctgataaaccttgtaagccaacagttcagctacaagtgagtcacgaggatcatcgtcctcattatcttcgtccatctcatctggttcaggctgtggcaataagaaacggctcttgatcgtcatcaaagtcgcagccataaccaaataatcaccagcaatatctaattttagcgctcgcatagagtgtaagtaatccaaatattgctgcgtaattgccgcaattggaatgtcataaatatccatcttgttttggcgaatgaggtgcaacagcaagtcgagtggcccctcaaactccgaaatcttaatggtgattggttgttgttggttgtttgtcacgattacgctcccacgcgccaatgattggcgccatttctaaagttcccatgacccgttgtttgggatacaacgcggccaactcatccaacatttgatactggttggccgccgtccgttcctcgggtgataatgaatcgtgatgcagtagaataaagtcactgccgacttcaatgccgataataccacagaaatcgccgtcaccttgccgccatagtaatagttgatggtcttccgttgactgataccactgcatctcagtttgtagatgaattaggtccttaaaatctggaataaatgacagtagccccattgctaccttttcataatccttccgatatttaacgagcacggtattgcctcccttgactgcttgattccgcaccgcatctatgcccgcggatgatatttattataaacctcagctaggcgttttttcgaaatatgcgtataaatttgagtcgtcgaaatatcggcatgccctaaaagctcctgaacgacacgcaagtccgcaccattttctaagatgtgagtcgcaaacgagtggcgcaacgtatgcggcgtcacgtttttttcgatgccagccgccttgacttctgccttcagatttttccaaaccccttgccgacttaatttaccaccgtgattattaataaacaaatagctattccggcgtttggcagagacgagtttgggccgagccgtttttaaataacgggtaataaaatcaatggcaacatcaccgataggaatgatccgctctttatcacccttaccgattgtttgaatcaatcccaagtctaagtgcagatcatccatcgttaaattaattgtctcgctgactcgcagaccggtcgcatacatcacttctaacagagttcggtctcgtaatcctaacggggtattcaacttaggcaccgctagcaaccgttcgacctcgcgtggtgacaatacttgcggtaaatgctgcgcccgcttaggcgtgtcgatttttagcatcggatcagtatcgatagcgtgcatctgtgctaaatattgaaaaaacttacgtaaactagaaacactgtgaatgattgtatttcgcgatttaccagcctcatctagatactgtaaataattcaataggacgtaccgatcaaccacccgatagtccgtgatttgctgactcatcaagtattcgctaaacgtagtcaggtcctgagaataactcttaatcgtattttcaactaacccccgttcaacacgcaaaaaatgcaggtaatcagcaagctggtcctgcattttttgatcaatcgtcggcttgctcatccgcattttccagtaacttgatctcgcctggttgttgactgatcaagcgttgcttcaagagattacccacagcgcgcttaaattgtgatttgctgataccaaagtaattccgaatatcatcgggatcactcttatcccaaaatggtagcgcgtggtcagcttgatgttgcaatgctgctaataacatttgggcatcatcgccaatctcttcgtatccccgcggcttcaaggacaaattcaattcaccatcgcgcaagaaaccaatgacccgcgccttgacgtgttgccccatgcgtggttcctgttcacgttctgacggatgaacaaagcccagatgattgtcatctgtaataaccgacgtaccggccatcttcaaacgaaaaacggtcgccatggtatccgtattcttaacttgggcccgatcatatggcttggcaattgcttcaaaatccgtcaattctgccagagtcgcccatagccgttgtttattgtcacgggctaacttaacgtataaacgatcatcttttttaggccatagtcgactgatggtcggtaattcgtctaatgacaccaccaagtccttattcggtaacccaacatcgacaaagacacccagatcatgccgcgtccggacaaccgttccccatacaaagtgatcaaacgaaatttccgggacaaaccgcgtcatctgcagatgatgatcttcattctcataaacaaaaccttcgtaaagcccgccaatgtgcaatggcttctctggttcagttttatcgacccacaacgtctgtccatcaatctgtacgaagtatgcttcatcgttttcatcggttaccttcgccgtaaccactgttccaataatactatccatgtgataactcctctaatatatccgtctataaatatcaacggatggttcttttaaattactgtaagctcaaatgtaagacttgaataatgcaatacgttataccagccgcaataattggcccggccgcgattcccttgagcaaaacaacacccataatggtcccgaatactaatgccacggtaatctctggtgtcgctgacaaaagcccgacaccgtgaaatgagagcactgaaaccaacactccacatgcaaccgcaatccagccaactggcgacttaaacgcatgccaaaggtcccgaaatccaatctgaccagtcgcaatcggaattaaaattgcgacggtaatcaccgtcacaccccaattgattcccttctgaccaatcgtcgtcagcaatttactcgtattaggaatcaatttgataagcaacacaaccacggtcgcaatttgtaaggactgattttttcctaaccatgccaccactaaaatcgctaataaaaataaccaactttccatacgacacctcacgtgttatcaattgtaactgaaaatggcccgaattacgaggggtgttggtcgttactcaccaatttcactatcccccccctgatcaataaccgattcctgttctttaatttaggcgggaacagggttaaaaggtgccaaatcgtttggattccagctcgtcagcaaggttcgtcctattccgacttacggggctgggtgacaattgccggaacgtagccgacgtcgatttgagctcacgcagcaacccactgtgcaatctcaaatacgagtcttattctaggccggaagcaacccacttccagccaagaataatttggctactgagcattgtcacccaacccctccagtcggtaagccagtcgaatggctgatgaacgaccacctaacttggtgcaacttgtcgctgaacgggtttactacttagaattttgaacatgcgttaatgctgtctcaattgttttggacacctcagtactaatacggtggaattagaaataatcgtacaatcacaattatattatcaaactaactgttgtatgataaaatcgctgttttaaaatagcaacatctaattcgttcaatgctgggtccactcatgtcagccattcgaataccatcccgactggaaggcgtttcggccaatgctcagcggtgaaattccacttagcaagcgtttttggcttggttagtggaagaccagtatttaagacgtgattttcggcttaaatctgtgtccaccgcgttccagcaattggccgaaatgcctggaagtcggtgcaggacgcagctagctaagcaaatttccgctaagtagatctttttccagcgggcttaagctggatcatttgacgttgacgatttggcaccttttaaccatgtttcatactaatttaactgggagtgaagcactttatgtaatataaaaagccgccgcaaagcgacgacttttcaatatcaaattagatttgatcttaaagggcgtttgaagcaccgcggtatacaaggccacgacgtgaatcaactgtgatcaattgaccatcagcaataacactagtagcgtccttaacaccaacgataacaggaattcccattgagataccaacaacagcagcgtgtgaagttaaaccaccgttttcaacaactaaagcactagacttttcgattgctggtaagtagtctttgtcagtcgtcttagtaactaagacgccaccttcaacggccttgtcgatagcttcttgagcagacgttgcgattacggctttaccgataaccgtttcatcaccgacaccttgaccatcagctaacttagaaccaattaattggatcttcatgatgttagtcgtaccgcgttcgccaactggcacaccggcagtaatcaagattaagtcgccttccttggcaaagccaagttcaacagccttagaagcagctaaatcaaacatgtcatcagtggtttctggtttttcagccacgattggttgaacaccccagttaaccattaagccacgttgagtccgttcgtcaaaagtgattgctaagatatcagcatttggacggtacttcgaaatcatcttagcagtgtagccagattcagtcgcagcaacaatcgtcttaatgttcaagttcttagctgcccgagcaatcgcaataccgattgtttcagtaacactagtcttgtcgaaacggtttaattgtaacgtaccgttttcagccaaagtgttttcagccttttcgtcaatcttagccatcatggcaacagattcaacagggtaaagaccgttagcactttcaccagaaagcatcgttgcgtcagtaccatcaaagacagcgttggcaacgtcagaagcttcggcacgagtaggacgtgggttttcttgcattgagtctaacatttgagtagccgtgataacaggcatacctaaagcattacacttcttgattaaactcttttgtaccaatggcacattttcagcaggaatttcaacacccatgtcaccacgagcaaccatcaaaccatcacaaaccttaagaatttcatcggcgttgtcgataccttcttgtgattcgatcttagggaagatttgaacgtgttccatgtgcttttcttcaagtaattcacgaatgtctaagacatcttgtggcttacgaacgaatgaagcagcgatgtagttgatttcatgatccaaaccaaagcgaatatcacttgagtctttttcagtgatcccaggtaagttgattgaaacgccaggagcgttaacacccttacgtgagcctaaaacgccggcgttttgaacagttgtaaccaattcgcggttagcttcgtccttttcgtcgatcttcatatctaataaaccatcatcaaagaggacatggccacctacatgaacatcatcatagaggttcttgtaagtaacggcaatcttatcatgggtcgtatctaatgaatcatccatggtgatacgaaccttgtcaccgatcttgtattcagattttccgttagcttgaacggtcgtccgaatttcagcacccttagtatcaagcatgataccaacggtcttacccgtaatcttttctgcttcgtgaactttgtttaagcgatctaaatgttcttcatgatcaccatgtgaaaagttaaagcggaaaatatttgcgccggcttcgattaatttaacaatagtgtcagtatcggtgctggcaggaccaagtgttgaaacaatcttggtttttttcataagaaaaatctctcccttgaaagtttttataaaaagacattaacgtcatttttatcaaattaaaataagaactaacatgccatgattacttgaatgaaatttcttcattcaacttatctaatgacacttcaacgtcatgcttagattcaaataaatctaagatgttgtggttgactaattggttgttttgaatcccaaccgctaagccacccttgccggcaagcaagagttccacagcgtaggcacccatcttgctggccatgacacggtctttagcagttggattcccaccacgttgcatatgagcaatggtattcccacgagcatcaaagtcaccatattcggataacttctcaacaaactcctgggcacccatcacaccttcggctaacacaatcaagttgctccgatgaccattggcccggttatgcttaatcttgttggcgatttcttccatgtcccaatcaacttcggggaccacgatagcagtcgcgccgattgaaacaccggaccataaggctacgtcaccagcgccacgacccataacttccacaacgaaagtccggtcatgactatgagccgtatcataaatccggtcaagagcttgcacgttggtgttgacagcagtgtcaaaaccaattgtgaagtccgtgtaaggaatatcattatcgatcgtccctggaagaccaatcgtgttgtagccgtgttccgttaagcgcaatgcgccatggtaagaaccgtcgccaccgataacaactaaagcatcaatcccaaaccgcttcaattgttcgatcccttttaattgaccttcttcatgggcaaattctggataacgtgcggagtatagtaaagttccgccgcgttgaatcacaccatctaagtcggctgcttctattttgtgaatgtcaccggcaactaatccagcaaagccgtaattgatgccgtatgcttccaacccttcagccattgctttaccagcaactgcacgaacggccgcattcataccaggagcgtcgccgccactggttaaaataccaatgcgtttcattttttcacctcaggcaataaattgagttcgtaactccataagtgattctaacacttttcacgtggattgtctgttattttctaaaattaaatgcgttaaaaaacgccgtcgtatcaagggatagcgttcttcatcaccacattatcgcgacctaataaggttgtaagcgctccaaccaaatctggattttctgcgacccaatactgtgaatttagttcaaccgttcgatgtgctgctaccgagtaaattagaactggattaggacctcgatattgacttaagatccttaaaatttccttttgcacagtcgccgttgcttgctcaggttgcaaccgcaaaaagagttggccggttggtttgggtaattgttccgccaactgccaggtgtttacgatcacttgcaaatcccgctgttgctcgaccttaccagtaattaacacgattgcttctggtttcaattccgcctgaatccgttgataggtattgggaaaaatcgtcaagtcaatttcgccggacaaatcacttcccgttgcgaatgccattggttgaccacgtttggtccgaatcgttcggaccttagtaatatagaccagtatttgtgccggttgttcactcgtgagcgtgctgactaattgtgtatgtcgttgttgcgcgagccaatcatacgtttccacagggtgccctgaaacgtacacaccaagatactccgcttctttggccaatcgctcacctaacgaaagctccggctgttttttgatcttaggggctaatgattcaaataaactcatactgccaccggctaactcggcacttgacatcaattcaggcacactggtcagtagctctgcacggttcaaaccaaagtggtcaaaagcccccgcatagatcagtgcatccatcaaatcggctttgagccacttcgcgtcaatccgttgcatgaactgctgaagacttttaaacggtccgttcgcctgccgctcgtctaacacactcgcaataaagtcacggcgcaaccctttgattgagctgagtccaaacacaatggcttgaccattccaatcaaagtattgaccgctccgattaatatccgggggaataatcgccacttggtgctgacgagcttccgctagatactgtttcagcttcgttccattgctcaacacagaattcatcaatgaggtaaagaacgctccggaataatggactttcaagtaagcaagttcaaaagccatcttactgtaggcaatcgcgtgtgagcggttgaaaccatagttcgcaaattgttcaatatattgataaacctgtgtcgcaactgcttcggaataaccattctgttgtgcaccagcgataaattgttgccgcattttatcaatcacagcacgttttttcttgctcatcgcccgccgcaataagtcggcttcacctagtgtaaaaccacccatgaccgcggcgacttgcatgacttgttcttgatagaccagaataccgtacgttggtcctaagatgggcgcaagttgttccgccggataactgaccggttcttggccttgtttgcgggcaataaaatggtcgatattttccatgggccccggccggtaaagtgcattgaccgcggcgaccaattcaaagttatccgggtgcagacgccgtaacacgtttcgaattcccgccgattcaaattggaagactccggtcgtgtcgcccgcctgaaataatttcagggtcgctggatcgttcaaatcgattttagtaatagccagtggcttgccagtttgacgctgcacataatgtagcgcacttgccatcaaagacaaattccgtaatcctaagaaatccatctttaacaaaccaaccgcttcaacagtgtccttagtatactgggtcatcatcatagtttcactacctgcttgtagtggtacgatctgaattaatggcttttggcttaataccaccccagccgcgtgtgttgaataatgtcgtggcaacccttccaaacggcgagctgtttcaaataataatttatttttagatgaatcagcaacgaggttttgtaaccgttgtgagccctggtaggcctggtcaagtgtaatatgcaattggtttgggattgcggcactccagtcactcatctcgtaagttgagaggccaaacacacggccaacatcgcgcagtgcttgctttgctgccaaggtcccaaacgtaatgatttgtgcgacgcggtcatgaccatacttatcatgaacataattaagtacctgttcacggcgattatctggaatatccaagtcaatatctggcatattcgcccgtttagcgttcaagaaacgttcaaatagcaagtcatattttaagggatcgacatccgtaatattgagtgcataagcaactaatgagcctgctgcagaacctcgcccaggtccagttgtaatctgggcctcatgcgcaaaattcatgacatcccacacgatcaaaaagtaatcatcaaagcccatctgatcgatcacggtcagttcgtgatccaaacggtcctggtaagcctgctgatcaaccgacggcgttattgccgccaatcgctccgttagaccagccgtgcataactgccgtaaataaacgttcgctggttgtccagcgggcgttggaaattgcggcaactgtggctgttgaaattgtaattcaacttgacactgtgccgcaatttcggccgtagccgccaccgccgtcgtcaatcccagttgctcatagtcagccgttacggtgttggccggccgtaagtagtgactgccttcgataccttgtaacgattcgggctgttcgatctgttggccccgatcgattgctcgcaaaactgaaacggcaaagtaatcctttgcttggacatagtcgactggatctaacgcaactaccggcaattgatgctgttgcgcaaaggccgtcattgttgttcgcaacgcaggggcctgatccaaggaaatccctaagtaaaggctagcagaatcgaccacctgcctcagcgtggtaatccaatcagcagctcgctcagcggtgttttgtaacaacagcgcagctagttcactgtctttagccggggttaagaccattaaatggttcaaataaggtaatacggctgttagcgacaatcctgcatccgtcgccgtctgcttcatcgtcgacaaccgcatcaagttttgatagccagcttgatctttcgcaagcacgaccagactaaacgtttgcgccgttagttcacgccctaataagttcaatgttattcccaatatcggggtaatttctgcctggcgacaggcattataaaaatcaacaataccgtacatgatatcaacgtctgttaaagccaacgcggaatacccctgttgcttggcagtttggactagctcactaactgtactagtgctgtgaagtaaactaaaagtactcaatacttgcaatggaacatattgtgccactatcgccgccccctttcataaaatatcagctttcaactcgcatcgaaaacgtaacatcagatcagctacgtcaagcccgctcccaattgatgggtaaacaaagaatttaccagtctattcaatgccagttgatgaccaatcttgtcctcagatatattcgttactattcattataccaaacagttgttctaagcggcagttttaagtcatcagataacgtgcacggttatgtttactagggtttcaccgccgtctcgtcgtaattatatcagcctaattaaagccttaatatcccgttattacctaattgctttttcctgtcggtgtgttaaaataattttcattgggaggtgtcggaaaatgatgagacaacttacgattatcttttggagtgtcctcttcggtgaagtcatcggctatatcggtggcgccctcgaacaactctcctataatcctggtgaaattggcatcgttgccgcaatttttgcgctaatcgtggtcaacagcatcacttatattactaatcattcccaacccgctaaaggttcagataataagtaattaaaaacaaccagaggctttgcttcgcttagtctcagcacaacaaaaaaagacgagtatcccgattgcggttactcgtctttttttgttgtgtgcttgacgcgccagccaactagaatgctggtacatacccgaccctaacattcagattaatgacgcttacgatccatcacttgctttgagcatttgcagcgttttggcatatttctgctttgcgcgttgtgctgctgcccaaaatgccaaatcggccgctgataaagaaccacgttgtacattaatttttcgattcattttttgcatactggtcaaaccttttacgatcgtcgtccatgttcgcttactcctcgattttggagtagcttaacacgacagcgtcggcggtaacaactcttttctcagtatgaggttaaacgcacgggcgcaaggtccccctcgtccgaagctaagcgcggctaccatcatcataaaccaaagatagctgcctcacacctacacgatcaagccatccagaatcataggctcaaccaagtcacaataataatccgcctaaaagaagctggaccgtgagcatcgcaaggtgctcacggtccagtttttattggcccaattatcgtcactgaaacgcattatcacgcgttcaaatcagtgattacgcttatgccggctgggtcgattggttttcgaagactaagtgatcgtccatcaaattaatggcgactgtcgattttggtgccacgcgccccgcaatgatctcttttgccagcggtgtttcgacgtgattcgtgataaagcgccggagcggccgggcaccgtatgccggttcatacccctgcttagcgatccacttcttcgcttcgtcagaaattttcagtgtaatctcacgatcttggagacgggcagacaaccgatcaatcaatttcaccacaatttcctcaattgcgcccaattgtagtggcgtgaacataatgatgtcatcgattcggttcaaaaattccggtttgaatcgactttgaaccagctgcataacctgttgatgggtgtcggccgacaagtgaccctggtcatcaacccccgccagtagcaactctgatcctaagttcgacgtcataatcaagatggtatttttgaagtcgacggtccgtccttgaccatccgtcaaccgaccgtcatccaatacttgtaacaagatgttaaacacatctggatgcgccttttcaatttcatcgaataacacgatcgagtacggattacgccggacagcttcggtcaactgaccgccttcttcgtaaccaacgtagcccggtgccgccccgaccaatcgcgaaacggactctttctccatatattcactcatatcgatccgaaccatatgatcatcggcgtcaaacaaattctcagccaatgctttcgctaattccgtcttaccaaccccagttgggcctaaaaacataaaagaacccaggggacgattaggatcttgcaaaccggcccgcgaacgtaatacggcatccgaaacggcatcgaccgccgcatcctgaccaaccactcgttcatgcaaatggtccgccaagtgtaataatttctcccgctcaccggcaaccagtttggctactgggattcctgtcatccgggaaaccacgtttgcaatctgatctggcgtgacggattcctcaactaaccaatcttcatgatgatcattggcttccatggccttcaactcttgttccagcttgggaatcgtcccgtgctgcaacttagctgcttgttccagatcataattattttcagcattttccaagtcgtgcttagctttgtctaacgccgactttttgtcgcttaacgcttggaggctcttcttttcactgtcccagcgttcggataaagcccgctgtttttcttttgcgctggcgagttctttttgcacatccgctagccgtttaacggaggcatcgtcagtttcattctttaaggcggcttcctcgacctctaaacgcattaattgtcggttgacttggtctaattccgttgggttggagttcatttcgacccggatttcagcagaagcctcatctactaaatctaaggccttatctggcaagtaacgatccgtaatataacgatcagataacttggcagcggccactaaggcgttatcatgaatccgaacaccatgatggatttcaaagcgttcctttaagccacgtaaaatactgattgtatcttcaacactcggttcagcaaccaatactttttggaaccgccgctcgagtgccttgtccttttccatgtactgacgatattcatctaacgtcgtggccccgatcaaatgaagttctccccgcgccaacattggtttcaacaagttaccggcgtccatactgccttctgtcttaccagcaccaacgatattatggatttcatcgatgaacatgatgatctgcccatcgctcttcttgatttccttgaggacggctttgagtcgttcttcaaattcaccacgatacttcgccccggcaatcagagaccccatatctagtgagaacaacgtcttatcttttaagttctccggcacatcaccacgaacaattcgttgtgctagaccttccacgatggccgttttcccaactcccggttcaccaatcaagacaggattgtttttcgtctttcgtgacaagatccgaataacgtccagaatctcttcgtcccggccaattactggatcttgattcccctggcgcgcctgtttaaccaagtcgacgccgtacttttccaaagcttgatactgatcttcctgattacgtgacgtgacccgttgacccccgcgaatacgatcaacggcattcttgacttgtcctgccatgatgccttgctgattcaagtatttggtcaactgatcaccagtttgatccatcagcgctaaagccaaagtgtcggtcgcaaggtaatcatcacctaacgctttgcgcttagcatcggcagcctgcatcagcgtagctagactactgctcatactgccaccgtactgaacgttaccaccgctaacaacggcaatgtcatccagctcacggtcgagctctgtttgtaattggtctaaatcagcgccggcctcactaaagatctgccgaaccagttcgcctggttgcgttaaaaatttaaatagatggggcaccccaatttcttgatggcgccgtgtttgtgcgatttgttgtgcctgttgtaaggcttgttgtaaactttctgtaaattgttctggattcatatttacgtacctcctcaaaaacggtagcaaaaaggcagccgtcatagctgccaatttttgtttgacctttattgactattagagtataacccgtaaggtcaaacaaggtcaaggatttagtcctggtcataattatcctgaacgatttgtaagacaacgtccacggcttgggccatcacttgttctgaaacgtattcaaaccgaccgtgcatgttctcaccaccagcaaacaagttcggtgtcggcaagcccataaatgagatcttggagccatccgtcccaccacgaaccggataaatggctggcgtgataccgagcttgagcatggctcgtttggccaattcaacgacccgcatatctttttcaatgatttcgcgcatattgtaatactggtccttcatgtcgaccttgatccgggccacaccgtcagccaaattcagccgatccgcaaccgccataaataaccgtttacgtgcttcgaacttatcgcggtcatgatcacgaataatgtaagtcatcttagcgctgtcaacggtcccgtctaaactaagcaagaagaagaacccttcacggccttccgtgtgttccgggacatcatgtgcgggtaacgccgattgaaaatcaacggctaactgcaaggcgttgaccatcttatccttagcttcccctggatgaacgttgacacctgtaatcgtcaccgtcgcttgggccgcgttgaacgtttcatactccagttcaccaagcggaccaccatcgacggtgtaggcataatcggcgccaaaggcaggcacattaaagtgatcagcaccagtcccaatttcttcatcgggaccaaaagctaaccgaatcttgccatgtttgatctcaggatgggccaacaaatattccgcagcactaatgatttcagcaacgccagacttatcatcagctccaagcagcgtggttccatcagttgtgatcagcgtgtgaccagcatagttctttaagtttgggaagaccgccggatccagcacatagtccccgtttccgagcttaataactgattcaccgtcataattgtcaacaatttgtggattgacattttccgcgttaaagtcagccgtatcaatatgtgaaataaagccaagagttttaacagctttgtcactattcgcaggaatcgtcgcaaaaacgtacgcactttgcgaatcctgttcaacatcgctcaagcctaaatcagtgagcttactcattaattgctttaaaaaggccgtttcacgtggtgacgaaggaattgtcgttgattcctcatctgaacgactattaattttgacaaaggttaaaaaatctgaaattaagtttggatattttgacatatgataacttcctttccttattaaagttcatgattaacttagatgaaggtaaacggatcagtattcagctgagacgccacaatctcgattggccagccagcttgtacacgccactgatcaaacagcttagtgagttgtgacttacaaatactctcgatatggtggcctggatcaatgaccgtcaacccggctgccagcatatcatgaccggtgtgataatagacatccccggtcacgtaagcttgtgcacctgctcgcaacgcttggggatagaacttaccaccatcgccgcccaggacggccacacgggtaatccgttgtcggggatcggcactgactagtcgcaggccgctgacaccaaatacttgcttacactgttcggcaaacgcctgcgctgataacggtgtcggcaaatcaccgactcggcccatataatactgatgaccgccagacaacagtggcacgacctggtaatcccacgtgtcagcggctaagtcattaatgcccgctaccgcagttggaatctgatcggctagtaagtcgacgctgaactgttcacccgagttgacagcgtaacgatctagcgtggcacccacggtattcgttaagtattcctgtaccgtttcaacttgattggtcggtaccgttaaagtcaacttaacagcctgtgcccgatacccaggaaccaacccctgcacattttgcaagtctagggccgccgccagccaatcgttcatgccgccctcagcacagtccagattcgtatgggccgcgtacaccaagatgtggtgagctgcaagttctgcatacattgctttctgaggatcctgataatcaagattgttagccggtcgaaacatgacgggatgatgagcaaaaatcatgtcagcaccgatcgtgatggcttcttggacaacttccggccgcacatccagggtaactaacaccttgtggatgtcctgatgaggatcgccgatttgtaatccggtgggatcatgctcccacttcaacttgagtggcgcaaatttttcaaaacgcgcaattaattcacttgcttgcatccgtcaagactccttcaatcaatttgattttagcgtgagccagcgctaactgttcctctggtatcactttagcccgttgcatttgcgcaaccgccgcatttactcgttgtaactcacgttgccacttagcgataaacaccggcgacttctcagctagcagaaacgggccaaacatctgttcagccgtcgtatacgtcacctgatgatcaacccgatcagcacaaagaatctcataagtatggccatcttcagctagaattcgttcagctacaatttgaaactgattggctgccagccattcccgcacggtcgcttcaccaacattaggctcgagtaccaaccgttgaacaccggcgagctgggtcggcccctgttcaagaatatggcgaatcaaagggccccccatcccggcaatcgtgaccgtatcaatacgatcagctggttcaatcgcagcaagaccgtcagctagacgggccactaagcgatccgttaaccccagtttttgaatctcatgacgcgcattttcaaagggcccccggacgacttcaccagctacaccataactaatttgatgatttaatgcgagattagctggcaaataagcgtgatctgacccaatatcggccacgcgggcgcccggctgaacgaaagcgccaaccgttgctaatcgttttgataattgttttgcatccacatacagttcccctttaattcgggaagatttacccacacgactaactttcagtggttgtggtcaaatccacccggttcaattgttttaattattcagtttaactaaccacgcacgtcactcgctatccttagtatgcaccaaaatcgaaacgtgctggtcgttgaattacgggtcggctctttatcagaaatacccaacgaggttcaactaagatcatggcaatacccaatggcctggaagttagcagtctgaacaaaggtcgcacactagattagacctttgttggccaatcatctttgaccttaaaaaccaacgcatttcaatggtgattcaggatagcacccgtatcaccgtacgttactaatcatattttaccatgcttcactgtgaatacgcattcagctggttaaattttcctgaaaatccctaagctttgttcaaactaactaaaattctattaatgcaagtttggatgacaggcagacatgccataatatggctaatgtcgactggcaagcgacatattatttaatgagagaaagtttgattaaccatgcgaaaacgtcttttaacgacgtcgccatttttgactggcctaaaattattagctattctgccgccggtaggtatcggatggctgatttatttaagccggtggcaatggctggcgttactcaaacatccacgacaattcagtcggcacgacccgttgctaggttttatcgtcctattaatgggcatcacgacgctcaatctcaatcaccacgattatcgtagtgttattctgtctgtcttaatgctttttgtattgggcaatctttggttgttgtgtcgtgagtccacgcagtcgattgcttggcacgagcttcgtaaatttatcatccaatttggcttgtatattacaattagtggttttgctttccactggcttaaccaagtattgacattaccaacgtggctgaagttcatgctgggtgacctattatggggctatgctgctaatcagaatcgcttgttcgggtccgcctataatccaaatgatgcctgctgtttattattgattgccctcggcttactattgacacagttaagtcatggaagcgttcaccccttcacgcgctggccgctcataaactggtttttggttggcttactttgtctgggcatttatcaaaccaaatcgcgcacagggctcatgatcatgatagccattctgatcatgacgacttaccagctttgccgtcaccatcgcattttggttacaacaatattgattgctggcagtttagttgtctggcacgttttccccagaagtgcttcgaccatcaccgcgcttcaaagtcgcttgacgatttggcacaacagcttcaccgttttcaaacaagccccgtacctcggcgtgacgtattttggctttgcccggcactatttgcaattgacgggaacctacgtcccacacgcccacgatattttgctcatgctactagcttcttttggtatcctaggcggtgccggctttatttacttagtcctcagcagtggctggcacttaaccaaatattggcaccagtatcgtacgccaaatttgcgttactttatgatgactttgcccatcattctagcctatggattgacggacttcgttttatcttctatgcaagtattgattattattttgctcattatcgcttgttggcaccacgaacaacaattgcggccaatcattagccctcacaagtatcagtctccacttatctgacacttttcatcgccatcaatttcgaacgggcagtaatgccccatttcaaaaatagtgtgcgctgtcggtcatcaagccgcaacacacactatttttagcgtaccgttaaccaaatcggcgatatgccaacacagttaacggcataaaaatcacaataataaggaaaccacttaacagtacaccaaatgcatcgggcccccaatggccagtccgcaaaattgtgcgcatcgcggtaattgttagactgaccggattcaatcggacaattgtttgcaacaaatgtggtaacgtcttagtcggaataaaggcgttagataaaaaggtcagcactaaaataatgatcattgacaggctgccaatcagggccgcatttttgaccattaaaccaactaaagcaaagacccatgaaagcgaccatccaacaaatactgccagcagtaaaacgccgatcaatactagtggactaacaatgggtcgccagcccatcataaaagctgtcaccagtgccatcaagccagaaataagcaatcggaaaacatcccccactaactgaccggctaacggtacgatcggtgaaatcggtagcgtcttgaagcggtcaaacacccccgcgttaatgtcttcacgtaattgctgtccggatcccgatgctgcattcaaaatactttgaatcaaaataccggtaactagcattggtaaataggcctggacactgcccgcaatggccccaccaaacaagtaaccgaataatagggtaaaaataattggttgtatcaccacgtcactaacattatctggattatgccacatttttaataagttccgatgcgtcattgtcaaaacatgacttaactctgctggttgtttgatttccatcgctttgacctcctctaatttgtgcccacggtcagtttaaaaaacacatcatcgagcgacggcgcgtgcatcgcaaagttagtgaccgtgatttgagcagcttgtaaccgcatcagaatttcagtgaccggcgtcaagttagcggtatccaacggcactgttagggtccgttccgcaacacggacatcttgaccgagcatgacttgtaagatatccttagccggtgggacggccgtcgtcgcactgacttccaattcaagctcttgaccccctactgtttgtttcaaagcggtgggtgtcccactggcaactaactggccatgatctatgagcgcaatgtggtcggctaactggtcagcttcctctaagtactgagtcgttagcaccacagtcgaaccatcggccaccagttgacgaatcgcttgccacatctgcgctcttgtccgcggatccaagcccgtggtcggttcatcgagaaaaagaatggccggtttaccaatcaagctaaccgccaaatctaatcgtcgccgcatcccgccagaaaatgtggccaaaacgtgatccgcagaatgcttcaaatcaaaatccgtcagtaattccatcgctcgatgcttcgccgccgcacggcttaaaccattcaagcgcccaaaaatctgcaagttttcccgcgcactcaggtcctgatcgatactagcggtttgaccggtcaaaccaaactgctggcgaacgcgtcgggcttgcgacaatgaatcaaagccattgactaagattttcccagcatcttgtcgcaatagggtcgtcatcatcctgatgaccgtcgttttacccgcaccattaggacccaataagccaaaaatttcaccccgttggacttgcagtgacaagtcttgaacggcgactttcgttccaaatcgcttctgaacatgggtcatttgaatcatcatttcttcatccaagttaaaacctcccgcaaattaatcaggtgccctgactaaatatatgttaaggccccctgactaaattgtcaacgactaattattgaccatcaatctaaaaatcaactaaccttaacgtaccgcataccaaagaatgttgtatacttaagaaaagaacgaatggaatgatcaatcgtgacaacgaatattaaggcggaactagtcgccggaaaattggccgagtacgaacaactaagcaaaatttatgatgacattgtcaagcaggcccgtccaagaataactgttgaaggtcagggcaagattctactagcactagccgatgaggaccacctctcacaaaaacagttggcaagtcgccttggcatgtcgccgcaatcaacgagcgagttcgtctataaacttgtcaatcgtcagctggtcactttatccaagtccaccaaagatcgccgcgtcaaccttgtgaacttaacggctgctggtcgcaaagagattgcatccgcagcccaggaggtccccccatttgtcaatacgctttctgacgacgagctcgatcaactggcacccttgttaaccaaaattaccaccgcgatgtatgcggatattgacgctgccaacccgactttgggcgttaagtttcacaaattatttgctagtcggtacttgaaacagtttaaaaagtaaatcatatgccacctgcccgtcatttttagatgacctcttgctccgaattaaccctgaatcagtatttggctctaaacaaacttaaaggcggaccaattcagttacgaattggttcgcctttagtgattatttaacttttaacaggaatcatagtttaccatttataatcaattgggtcctgtaagccccggccagtcgctttgtccaacataatgcgttgttcaaagtgcgccacatttcgtttagtctccttgaccatatccggattgactgaaacatagtcgatgccgctttgaatcaggaagttagtaaactctgggtactctgatggtgcttgaccacaaatcgaaaccgtcttgccatctttatgggctgtcttaatcaggtgccgaatcgctcgtttaacggccaagttccgctcatcaaagaggtgagccaccgtatcattattacgatcacaacccagaatcaacattgcaaggtcattcgaaccgatcgaatagccatcaacgaattgattgaattggtcggccaaaataatgttggttgggatttcagccatcatatagactttgaagtcagcactccgagctaggccttcatcgcgcataatggtcgttactttttgtgcttcgtcaacggttcgtacgaatggaatcatgacatttaaattcttcaacccaaattcgttccgaactttcttgaccgcagccagttccaacttgaaggcctcgatatacttggaatcatagtaccgagatgcaccccgccaacccagtaaatcagctggttcatgcggctcgtatttgtcgccaccctttagattacgatattcgctcgacttaaagtctgagaagcgtaggacgactggccgtggtgccattgcccgaacaaccttcgcgataccatccgccagcatattgaccaccttttcagggtgaccctgctcgatcaagtatagtggatgttcatgaataaaggttgtccataggaactcttcgcgcattaagccgattccatcagctggtaaacttgaatatttgtcagccaaatcaggatcacccaaattcatcatcacgcccgtagcagttggagcaaagctctcggccgcaatcacctgaccagcaaccgccgtagcaccactctttggcttcaacatgccagcgactttaccttgataaacaaccccgttcttagcatcgacggttacgacatcgccggtcttcaagacgtcggttgccgcgactttcttacttttagtgccgacaatacatggaatctgcatctcacgagaaacgatcgcagcgtgacaagtcatgccgccgttattagtcacgatcgctgcagctttcttcattgccggtacccaatctggtgatgtcattaacgtcactaacacttcgccttgcttgaactgatcaatgtctttcggattatcaatgacatgcacgaccccactggctaagcccggactagctggtaacccccggacgataactttagcatccgcctcatccacaacatcttcatcgtcagctgcatctttgtgcttattacgctgtgaccaaactgtttctggccgcgcttgaacgatccatagccggttggtattcgtgtccaaagcgtattccatgtccatataacaaccgtaatgccgttcgatttctttagcgtagccggccaattcaatgacttgcgcatctgttaatactggctgaccctgtaattcatcggggacggactcttccttagtcccgccacccggtaaccgcattaattggacaggttgtttgataatattcttttcaacgattttcattgattgtttatcgataacaaagtgatccggcgtaactttgcccaacacaatatattcacccaaaccataaatggcatcgatcacgatcttggaagcatccccatccgctacattgacggagaacatgatcccggaagccttagaaaagaccatcatttgaatcgccgctgagagggccactttttcgtgtggaaaatgctgtttgtgccgataatatgtcgcgcgatccgtgaacagtgacgagtaacattgttgaacccgattaacgacatcggcagcacctttaatatttaagtaagattcttgttggccggcaaatgaagcgtttggtaagtcttccgcagtcgctgaagagcgaatcgccacgaacggatcagtttgccccattttcttagcgagatccgcataggcttgttcaatatcagccgccagatctgcgggcattgtcgcattcacgatcaagttacgaatttgttcgcacgcagtatgcaattcatcagaattttcataatcctgaatgctggctaacaaatcattgaccttatcattcaatcccgtctgggtcatgaagtactgatacgcccgggcggtggtcgcaaagccatatgggactggaacatccatcgatgacgtcatttcacccagtgaagacgacttaccgcccactaggttcacatcttcgcggtgtaattcatcaaaccataaaacgtttgccgtatcacgactactcataagattacctccctatgttcctgcacttgaatatcatcattatcaaacttaagttctgtaagcgtttacattaaccatttatattgtagttcatttttacacaaagtaaaacccattttcattattttatcggcaaaatatagttggtgatgttgactggttacgcccgttaaagttcaacacaggcttgaaagaaaaggcatttaatggggacatgttttcaaatcaactcggattataatgataaactgtaaggccaactaattaacgaacttatttcacaatatacgaaatcaactcattgtggacgacgcaacccagtgtttatcaaaaaacgcaaagtagccagcggtgattactttcatcaccgctggctactttaagcgtctagcactacaactatgacttaagtctaaatcgatatttcactaatccgcaagcgtttcaactggtagttgcatccctttccagccttccagtgctcctgccaattcgtatgcttcaaaacctgcggatagtagcacgagtaacgccgtcttgccaagggttgttccccccgtccaatcatacacgacataggtcttcgccggatccagttcaccgattctggttgccagatccttggcaggcatcgcgattgcacccttgatttgatctttcttcacttgggccggtgcattccgaacatctaagacgacgtacttgcccgtcgcattttgcatatcggctaaaacggtgtgatgatcgatgtataagcttaaatatgttgttaacaattcaattttcttgtcattcatgattaattgcctcactttttaattgttgggtgccttgcttgattttatccaataagcctttaaactgctgctgctcttgaaccgtaaacgacgcaaaaattgttgtaaccgccttaaaattggccggtaaaaattgcgtcaaaacactactaccggcggcggtcaaatgaatggcaaccgtccgcttatcatcttgtggatgctgcttttccacccagcctcgcttttgcaagccgaccagtaacttgctcacagtcgcccgagcagaccctagctttgtggctaactccgacggcaatagcgtgtgatcagtttcattttccagcaacattaaaataataaacttggattctgaaagttgatattgatcgagtaattgttcataggtggcttgcatggttcgaaatgtccactgaaaatccagaaaagccaacacctgatcagcatccgccgagctacttgctttgcccagtgtcaattgcactcgctgtttatctggtcgatcacgaaacgaaaagtcaggcattgaaatccttctttctaaagttaattagccggctaactacttttagaagtatacacgctttttcatcatcgtcaacccttaaatcggactagccgttattcgaaacactcaccattcaaataaccctagccatcaagcaccacgacatttttcgtttaaactgatgcagattgaaatcaatagattagcgtgcgcgactcaacagaaaacaagcagtcagttgtgaaacctcccaacactcatgaaccctgcgcacaccaggtccagtacaattgacactcaccataatcgcatatgctatactgatgatcacgatacctattgatttggaggagtaccctaatgcacaaattagctattttggtgatgacaattggccttgcacttgctggttgtacgacccaaacattcgctccagtgaagcatcatcggtccgtcaaagcgacgacccaaaaagtgattcaagcaccaaccaaaacatggacttttggtcaagtcgttagttccagccaaacaaaacacggcgtcgccagcaatttagacatttccgtggttgacaaaactactgcccaatcaagctggaccactagtaacggccaatttttgtccgccggcgtcaaacatcgtcaagtttcgtacgccaaatggcaccatgatcagcaacgccatatcatgaaaagttaccgacaccggctgcatcacatgtcagttagtcaaatcaacgcggttttgaaaaagctcggtgcctcaatccagattaacaaactgactgacttaatttacttggaatccggcaatcacaccgatccgttaccagtcaacaccgcctttgctgctaaggggcaccacctttacgctgtcaacattcaatattcagatactgagcaggcaacgaccattgaactgggccgcgatttcactgataccagtgccaaggctgcgcctaaacacgtcaacgtaacgaatttgaatggtacctgtatcgctgccgaaactacgactagcgctagcgatacaggcaagttgctgatcaaagatggctacctatatcagcatcgttatgatagttatgaacgatctgctatccaggacctcagtcactattcattaggctcactgaatcaaaacgtgacctatgcggccttcaaaaccgatgcagcccacgctggctatcaattaacacataccgccgttgccagtggtgatagtaccggtatgttatatctcatcatcaacgctaataaaatcatccgtatcaatcagcagattgttacgacctatacgaaaaccagtgccgttgtcgctgctaacgacctaccgaaaacagacgttgatttatttaagcaaatggatcaaaaaaaagctggtgaagtcgccacgacgattacggtaaaggccggtcccgcgcaagttggcatgaccaatagtattaactatctaaccgaccccaatgctggtcaaattacagagacaatcgtggtcaactaacaaccaggcgcttcatttgaaaaattatcaggtagtcacttatcaaaaacgctacttcataaagcgcgcagcaaaagccctgttgacctaattcccacatcaaaataagcacgttgtaaaaccacactctggtgatttttacaacgtgcttattttgtcatcgaacatctgcacagcatcaataattttatgattaacacagtaacgcaatttcacgacacctcaagccgattcagaaagtggtctggtcaacttacatcccagtttgacacgacaattgtcccgctttaatcatgaagaatacgactaattacgaggttagcccctaatcatgctcgtattcacgttttagtcgcatccatcctgcatgcagacccaaagccgttgtaaaggacaataaccaggtcaaaccataacacagcgcaatgctcagccagggagccttgaccatcaaagtacgaccaaaaccgcgccacaacaattcagaccagaaaacattcgctaagtatgccttataggccataccagcaaagaaatgtacaaatttgctaaaaggccgttgacgacgaacttgaatctcacacaatgccgccaacaggccgatgactgctagcgcataccccgtcattgatggtttgtaatacggggcgttgcgcaaattaaccgggaagccgtaactgaacagttcccaattagtccagatcaggccaactaaccatagaccaagtaatcccggccaccacttgttaagcatgcgctgaaaggtatctcgaaacacccaagctaacatgccatagaacccgaaaatctggaaactgataaaaagccggtccagtaaataccaaccacggctgtgaggaccatggaaaacttgttggttataaaaccacaaccaaagaacggcgaccagtgttgtaccgccaaatacgatccagccgcgtcgaggtcgagactgacaccaacggccaagcgcccagaataacggcattaatatgataaattgtagcatcatggtgttataccacagatgaggcgctgcattaccattaacgaactgccagaaaaatccccgccagtcatgatactggctaccttgctgcaattgtggcatcaagattaagtagatcgtggtccaccaaatcgttggaataaacagcgcatgccattgctggcgcagatagtcggtataggtcaacgcggtctgattaagcgtcaaacgcgtcgtcgtatagagaatgccaaaaataaaggccggtgccgtatacttgaccagattataaacaacaccaatcccagtttgcatggcaatcgacggcccacttgccaatgcgtctgtgagaatcggttgggccatcaccgcagtacaggcccctagtttgaggtaatcgccaacgtcagtgacctccatcgacggactagaaatcatcgtcactgctaacacctcttcgaatttttaccagatcaaccgatggtcaaccttaaacccagtctaatagattcccatgggattacaagtacacttcgcgaacattaccagctaatgattgtattttttgatacgattccaactgctttacccttcaagcaaaccatacacttaagcgagcatttaggcaaaaaatcgcgtcagaccagtcagcattagccgatttacggtcagacacgatcgtgatttctttattatagattcctttacagatttcaatccggtggtctaagtccaacttgcaagtactaggctgagcagtatccaaccaccagattactcagcgttttggtccaacaacacaatggcctttccaaaactgtctgccgcttgcaaataagcatgggccgccggtacctgattaaagttaaaaatccgagcaggggcgaccgacacatgatatgctgcgatgaagtcaaataaatcttgcaacaatgtctgagaaacatcgccagaggaaaagcccgttaaataacacccattcggaatatcactaatcgggtcaaaatcaggaacggtccacagcccacctaattcgcccgtcatatttacaatgccgccttcgttgagatgcgacaacgaatctttgacactgagcggaccaatcaagtcgacaattttatcaaaatgagccgttgcggctggtaaacgagcgctatccggagcgacaatgacctcatcaaagccagcatcaattaattgttggcgcttaactagccgccgagtagtcccggccacatggatcttcggattataagccttgatcagatttaaatcagcaatcccaaccccactagtagctgctcgaattagcacccggtccgtcgctttaagctgcaaagacttaaaaatgccataggccgtgtagtaggtctcaggggttgccaccaatgaggcaatcgatagattcgttttgatcggataaacctgctcgttcggtaataatacgtattcggcataactaccatcatatgcccgacccatctcacccatgattgaaaccacacgttgcccagacgtgaatgttgctggcgcactggtctcatcgaccacaccaactacttcgattccgagcactcgtgggaactgcacgctcggtgacttgccttcccgcgtaaagatttctgagtggttgataccaaaacctaaaacttttacccgggtccaccccggtttgacgttcggtttaggaagcgtcgttaattgtaacgcttctggtccacctggttggttcacgacgtatacttgcaactttgctacctccgttcgtttttaatgccaatttaacgatagctgagattcacgcttttcgcaattaattaatcccctgcggaatatcaccgttaatatcagcattgtaatcatttagtcaatcgtcgccagaggtcgccggccaccgtcaaaccgataccagtcattaacactaatacgatcactattaaagttagccagccactaatagccggcactccccaatcactgctagctaatccgatggtcaacaaacagttcaagccgatggtcaccccaactgcgcgactaggccgtccccgccaaaatggaccactagtacgagtcatcaagattgttaacattgcactaaatatgagatagacgtaaagactagtgctcaactgaccggcagacaaccccaaaccatgcagccagactatcaaaccaacacccacagctgtccaaccagtcgctaggaaccccgcaattttgcttaagcggggcatatcccactgttcgggacgatggcgaatggttgtgcgatcagtgccaaggaccaatgttactaaatcattcagaatagccactaataccatcgcattcagcgacaatggcacgtaatctagccataaatagccgattgttaaaagcacggtcagttcgaccgtccgagtgagtttggtaattgtccaagtcagcatccgctggtagacgcgatgaccactgtctaaaatcgtcagaatatttgccaaaccacccgttaacaggacgaacttagcacttcgtttggctaaatcagtggcattgtcaacggcaatcccaacctccgactgctttaatgctggcgcatcattaacaccatcgcccgtcatccccaccacgtaacccgcgcgctgcatagctttgacaattgccaatttattctctggaacaacttcggcaatcccggcaacttgcgctaacggtcgcgagtgcgttttaaaggtctggtaggaaaccacttggccctttaatccaaccgcatcagccacagcctgtgctgtttttaaattatcgcctgtcagcataatcgttttaacgccccggtgttgaatcctttttaaggccgccgcactatctgggcgcggttgatcttgcaaaatcaacacaccttgtaaaacattattaatcatgaccgccactgaacggccccgggtcaaatccagttggtcgattgctaaagccggttgctgtgcggttaactcgtacaaacgactaagtgcaccaatacgtacccgcacaactgttggcgcttcaccaactagcgcttcggcataaccaacacttgcatcaaatggcttaaattcctgctgtggcagccgtttcaactgatagcgatgagcaaagttcacaattgcttgatccaccacgctaggatgtcgcgaatcggtcgcgctagctgctaaccgcaacaattgctgatctgatctggccgacaaatttttaaactgcacgacttgcggctgatttgtcgttatcgttcccgttttgtcaacaagtaataaattcaaattggcagcttcctgaatacccgttaattcactgaccagaatccgctgccggctaagttcacgggcttctaccgaatttgcaactgcaaaacttgacggcattgcaatcggaatcgtcgcaatgaacagcatcgctagaaacggtaacatctgaatcatatctgcatggcgaattaacgctatcccaacaatgatgagtgctagagcactatctaacaatgccaaataaccaataattttacccaataatcgttgtaaatgaccaggcgcattgttttgattaatcaaactgactgtttttccagcccgactatgacttccagtcgccagtacgcgtgctaaagtttccccggctaccaccattgtgcctgcaaaggccgtttcacccgacgtatggataactgcaacggattcaccggttattgagctttcatccgtataaattggattcgtcaacacacgaatatcagccgggattacactccctacctgtaaactaatcagatcacccacaactaaagccttcgcatcaatcaactgccaatgaccagcacgacgtaccgaactggttggcgtcaattgatgcgccagctcctgtaaaaccaaggccgcacgtcgcgattgaattgcaccattgacggctgcaaagaccagcattaacgcaataaagccagcctgaatttctttacccaaaacaacttcaataactaaggctccctccaaaatccatgccgatggttcccatagacgactgactacggccttaaaaaagttaaacgttggttctgggacatcattaaatccatctgccgctagtttagcggctgcttgttgctccgttaaatcttcaatcatgtctgcacctcgaatttgacaagcaccactggcaatctaactgtcgaatcaggtttatcacaaataattagtcaaacatcacgttatttgggaagtgtgccaaccgagcaccgtcagcacctaattcttcctcaatccgcaataattgattatatttttcaacgcgttcagagcgggctggcgcaccagcttttagctgagccgcattggtggccactgtgaaatcagcgacgaaagtatcaccagtttcgccagatcggtgtgacatcatcgtggcataaccatttttgcgagctagccgaatcgcggccaaagtttcggtaacggtcccgatttgatttaatttaattaaaatattgttagccatcccccgctgaattgcttgccgaattaattgcggattagtgcaaaccggatcgtcagccacaatctgaagctggtcaccatgagcagctgtaaagcttgcaaagttatcccagtcctcttccccgtatgggtcctcaattgaaacgatttctggaaatttcgctaataactgcagataataatcgccaagagctgccggcgtgtacgttttgccttcaaagtcataattgtgggtcgttcgattataaaaatacgaggccgccgcgtcaaaagcaatcgcaatttctttaccaggtgtataaccagctttaataatcgcatcatgtaatatttgcaaggcttcttctgagtttttaagatcaggcgcaaagccaccctcatcacctaaaccagtcgtgtacccggcatcttcgataacttttttcaaagtatgataagtattcacgatcttttcaaaaccgtcccgaaaactggttcgttcgaccggtgtaatcatgaattcttgaatatcaatgccattatctgcatgctccccaccattgatcacgttatgaaatgtttggggtagctctaaatcagtgccacctaagtaacgataaagcggctgctgtaatgcgtttgccgccgctcgtgccgttgccattgaaacacccaaaatagcattcgcacccagacgcgctttgttaggcgtaccatctaggtcaatcatgatttgatcaatatgggcttggttaaacgggtcagcaccatgtaaagcatgattaatgaccgtattaacattattaacagccttaagaacacctttgccggctaaacgatcaccaccatcgcgtaattcaactgcctctttttctccagtcgaagctcccgatggtacttccgcgcgtcctagcgtcccatctgacaaaataacgtcagcctcaactgttggattaccccgtgaatcaaaaatttcgcgagcctttaccgtttcaataacttgtttttccatatcaatctctccttcttaaccaaaaagaaaagacgcctactgtctgaaaaacaaacagtagacgtcatcaaattgattatcaattattatgtggcgaacgtcatcgccgattaacttttgaacaactaaagattacaccttctcaaaacaatgtcaatctttttataacatttttatcgttgaccagcttgacgcgtcttcattgccaatatcatggtccccaattcaatcagcactaaaatcagcaataaccccaacgccatggttgaccctaacgctgtccgatgcgcactagttccagtcgtctgtacttgaactaacgtgataacggcggacacgactgaagtcccaatggcccctgcaaactgctgcatggtattgaacacggcattgccatcagcttgatgctcagctgacaactgctgtaagccactcgtcatcgtattacccatggttaagccaataccaatcattaataaaatgtaaatggctaaaatcaaaccgcctgacaggtgcatccccaacaccgtaaacagtgccatggcaataaccaaaattgttgaacccgttaggactggtttggctgcacccagactgtctagaatacgtccacctagtggggcaaaaacagccccgattgccgcgccaggtagtacaaacaagccagctaacaaagcactcttgccgttcactaactggatgtagttgggcaatatgaaggccaacccgagggcacagatttgaaccaaaaagtacgccattaagtgcaaatcataagattttgtggtaaaaatcgccagattgattagctgttgtgccgctcgacgtgtgcggataacgaaccccacaagaccaatcagaccgactactagccaagccacaaaaatcagtggttgcgtggtaatcgtggctaatttgctaaatccaattgtaaagccaacgaataagaggacgatcatcagccaaccgaccacatcaaatccaactttaactgtcggctgggcttgccgaatcgcatatagccctaacacaagtgaaatcacgagtaccgggatcagcagcacgaaaatccaatgccaatccatccaactaacgatcaagcccccaaaagtcggccccagtgctggggcgattgcggtaatcagcgtgccaattcccatcaaggtccctttctgccgtgccggtgcccaatcaataataatattaaacatcaacggtaaagcaatcccagttcccagtccttgaatgattcgtccagtgactaaaacgggaaaactggtcgcggtcgcgtcaacgaccaatcccagtataaacaataaattggctgtcacaaacagcgttttagtgcgaaaacggcgtttcagaaacgccgaaattggtacaataattgcaactactaacaagtaagccgtggtcatccactggaccgtcgccgtattgagtgcaaattctcgcatcaacttagggaaagtgatattcatcgcagtctccacgatcactccgcaaaatgaaagtaatccggcagccacgattgcaagaatcaatttgaggtcaacacgtttttccatacttaaaatcagctccttaacctatagttcgaatacgaactaattaactattttagcacactatttcaaaattttaagtcctattttaattgactttttaacaattagttcttataattcactttagttagaatacgtaccataatatcattaaggagtcctcccatgcaagattcattaggaatcatgattaagaaagcgaacaatgcattagccagggactcagaccattatgcaaaatcactgggactaactggcatgcaaatcagtacgatcaactttattgccaacaatgaacagcatcacgacctcttccaacgggacttagaattagagttcaatattcgtaaagcaacctgttccagcctcgtttccaaaatggaagccgctgatttactcattcgcgtgccagcaaaggacgatggtcgctacaaacgactactcctaacacccaaggcccgccaattagccaccaagatcgaacgtttctttgaaaccagtgaacaacgaatggcgacaattttaggggtaaataccgccgaaacttacgaagccctgcgacaaattgccgttgctttttcaacaccgacccatgcacctgaaaattggtactaaccgttcaaagacccgctgacagtcactgactgccagcgggtctttgattttacgatcgatcaacaccgattactcggccaaaaaacgtgtaaacagctgttgataaattgcaataaagtcataaaacatctgttttggtaaactttcattgacctgatgttgggtcatattacccggtccataaaccgcaaagggaaaagcggctggttgacgcttagccaaattagaagcatcggtaattcccggacttgaggcaacgacaacatcgcggccagcataaggcttgccaatggcctgcactaactttactaaccgattatcagccgtggttgcaattggtgactcattcatgataacggtcatcttaatgtcagcaccttgctgattatatgccgcgatcaggtccgttaatttttgggtcacttggtcattatcgtattccggaatcgtccgcacattaacgagtgcagtcgctaaatcgggtaacgaatttacttggtccccaccgtttaacacgtcaatgttaaatctgaccggtcccatctcgcctgccggaatcgtttcaaagtagtcattggcttcattgagtaatttaatcagcgggactaaggcattatagccgcgttcgggtgtcgaactgtgtactgccttacccttagacgtcaattttaagtcataagaccccttctgctcagccgctgttccataaaccgttgaaggttcagcaatcagtaaaccagctgcatcttgcatcgccccttgttgataaaaggcagcagaaccagcttcaccaacttcttcgcccattgtcgccaacaagcgaatggtgccatgtttagggccaccttgctgctgaatattgatcatcgcaacgactaatgcgactaaaccagccttcatatccgtgacaccccgaccaaataactgaccggatttttctactaaggtgaaaggatcggtgtcccacgccgccaggtcacccgccgcaaccacatccatatgaccggaaactgctaaaacaggcttcccatgaccaatctcagcaactagatttgcacgatcaccggtaatggggtgaattttagctgaaatatcatacttcgccaacagggcttgcaaatattttgcgaccgtcaactcatggtcgttaactgatggaatcttaatcacatccgctagaatcttaagcgctgcatcgtcttcaatcgttcgcatattttgccaccaacttttttatcttttattttagtgtagcacgagacccagtcatttcaatcattaattggattaacgacactaaaaatagggattgttcaataagggttgccaaagcatttaggaactacatcacgaacacgctcgttgacactgatactaaaaaacgtggtgccatcagaaattggtttctaatagcaccacgtttaaatattaattaattatttcaggaataacctgttacagttatgttggattaacttacttcaagctcttgttgacccacttaataaagttggtttcattgttacccttgcgttctgcttcggtatggccctggccccaaaccgtcgcaaaatcaacacttttaacttgtgaattttgttttagcgtcaatgctaagttggtctcaacagtcaacgcagtatcactctgattgatacccgtctgaatccgccagtacttggctaccttgctcgtgttataaccgtcataataactggttagataatatagtgggttatataagttcatccgcttctgaatcgaacttccctgggcatccgtcttcttcaaatccgaccggtaagctttggcgtagcttgctttgtagttcttcaacttggcatacttcgactgattagtcgttaataacttgctgatagttgcgtcaaaatggttagcactactcccattcgtggcaaatagcttattttctgtttgttggcgcgtcaagccatcaaaagccccaacatcctttgaagccgtcttacaatgcttgacgaatgctttcacgctcgtaatcgttgccgtgtttttcttagcattatacgtgatccatttgccgttcttattgagcgccttaatataagcagtcgccgtcttataagtctcaccactcgtggacgaactgttagtcgccgtgccagatggcgcactgccagacggcttactcccgctcttagccgtaccgcttggcttcgacccactaggcattttaccactcgttaaagtttgtgacgctgcgccacttggtccttcgttgctagtggctttatatgggaaagtcgtgtccttcaaaaaattattcagtgattgctcaacttcttttttcagatatgtcgcataagtccccgaagtataaataccactcgtcgattttttgagcgtcaaggtcttgccgttggcatctttcaaccctaatttattgatatattgtgcataactcgtcgccatatcattcgacaaagctttggtccacgtaccttgtttacgagtaccagaattcgagtattgccccatattccattcataagcttcattggccgtatctaggctagtgattgggcaccaggccatcgcaccggccactgcatcactagtagatttacccgttgttgtcgctaacggggccccaattgctttcaagtaagtggtgtactttttgctgtcaccggtggcacccattaacgcactttgggcacccccaccactatggccaaacgtgaaaactcggttggtgttaccagcaatacggctacgattcaaacgaaaggtgcgcaccgcggccttcaaatcagtcacaccccatggcgacgaaccattggatttatctgactgactcaaaccacgacaaccagcggcaacgtatataaagccagccttagtatacttgttcgcactgctatcataacccgttggtgccgtttgcgcagcataaccaggtgtattcacgggcatcacgattggggcagttttagccgtgtaccccttaaccttagccttgttattgaacgtaatcgtgtaagtcttctgtccactagccttggcattcacgtactttgccggaataaagattcccattgattcatacgtactactcgttgttttagtaccatacttaacgccaacctgataatacactttattagtggcattgtagtgccattgcttttggttgatcaacagtttcttggcatttttcacatcagcctttgtgaccgtctgtttcgttgctttagcaactttcgccactgtgctcgttggatgtttagtcttcgtttcggagtgtccgcaagccgctaacccaacactcattactaacaaaccactcatcaggggcacaatttttctgaattgcatgataaaactcctctacaatatctgactttattagttggtgaacacgtttcactcccattgccgctaaaaaatcagtgcaaaagaacgacggatgatacggtagtcgtaatgaccacgttaccagctatcaataattagaattagtccctttactggtaaggttattttatcatcgccatcatagccccagcaacacatcacaccttaaactttcaaggtgtacaacgaaacggtcaagctgacattttcgcaaacaattcattcaaaatcctgcatgcttcggtctcaaaaagcgcttaacaccctatttcaacgcagtattattcataattaagtggcgtgttgcccgtgattgtcagggtttaatatttttttacgcccgtgtcaaaattgaggttcgccctgttgtctgatcattaaaatattcatactgaactagttcggcatacgacccagcaatgttgaccacattcgtatagccgcgctgaagtaacgcgcggaccatattgtaacttcgctgtccggtctgacaatgaatataaactggctgattggttggaatttccactaagcgctgtcgaaactgactcagtggaatattatgcgcgcccttgatgtgtccatcagcatactcttgtggttcacgggcatcgataataaacgctcccgccaagaccagctgtcgaacctgcgtcaccgcaacctgcttaaattcatcattcaggacgttttccgccactaagccaaccatgttgacgacatttttggcggtactgacccatggcgaataacataattcaacatctgtcaggtcactgactcgaccgtgcatcgtgattagactagcgataatatcaatcggtttgtcgacgtccgattgaccaatggcctgtgcgcccaaaatctcaccggtcggataactgaatatcaacttaagaaagacggctgttgtccctggcatcacgctgacccgattctgtggtgccaccgttgcgaaccgataatcaagttgctggtgctcacactcagtagcgttcaggcccgttgacgccacgtttaacgtaaagacgtgaagaacctgcgatccgatcacaccctgatactgtggcgtccgcccgtataaatgatccaccatgtgtcgggcctgcatttgtgcaggaaatgccaatgctagccgcgtagattgacgtgtaagccgattagtcacttcaatggcatcacccaccgcataaatgtcggccacggacgtctggtaacgatgatcaaccttgataccaccggtcacgcctaacgcacaacccgcttgaaccgctaattcagttactggtgtaaccccaattgccacaatcactaactggctggtcacggcgcgtcccgaggcgagctgcacttgtgttgcaccaatggccgtcacttgttcttgcagtatcacctgcacaccgtgatcgtatagttccttgtgtactagctgagcaaactcgtcatccaaagtgcccaagacgtgctcggcagcctcaatgattgtgatctgatagccagcctgttgtaaattttcagccatctctagtccgataaagccgccgccaacaatcgtcacatcatgaacgtgttgttcagtcagatacgcttgaatcgttcggacatcttgaacattgcggaccgttttaacattgggccggtcgattcccgcaatcactgcgggtagtatcggtcgagcaccaggtgaaagaatcagtgtatcatatgggacgatcgtcgttgctacctgtccttgccgtttgatcatcactgtcttagcctgcgcatcaatggcgacaaccgttgtattcacttgaacgtcaatattgtactgttgctcgaattgcatcggtgtctttaaaatcacgtcatcgggctggtcaatcacatcactgaatgtgtacggtaaggcacaattggaaaatgagacatccggccccttttcaaaaattgtaatctgggcgaactcgtccaatcgacgcacgcgggccgccgctgaagcaccaccaccaacgccaccaacaatgaccacttttttcactttcatctgaaccatcctttcgtaggtatgctgtagccctgccactaattagcttaattttaagggtttcaaggcgtaaccacaacatcaacgccgattaattcaaccgttttcattaattgacgtcattggctttctatttaagctaaaataagttagtatgtgtttaacacttaaaaaaacttaaggtgatcaattatgaaccaaaaaacacgcttagcattgattcttgatgaattaaaaacccacccatcactgagtttaaaagacattatgcaattaacggggacttcacgcgacactgcccggcgcgatattgtcaaactcgcagctcataatttggctgaacgaaactacggcggcattagtcggccgaatacgtttaataagctagatcagtacctggaccgggatgatgacttactgcaaactaaacgagccctggcccacactgccagttcgtatttactaaatgatgcgttattatttctagatatctcaaccaccgttgcctgtctaccacaatatctccagtccaagcaccccggcatgatcgttacgaattcccttgacattgctgaccaggcattacgacatagcaattttcaaacgcgtatcctgggtggcacattagatgcacaacaacggtgtgttcaaggcgctgacagcattctagcactacacaaatttcgatttacgaccacggtcttgagttgcgctgggttgaccgcagacggcgtttattacgcttacgaatctgatatcgctttaaaggaaacgttacgcgcccaaagcgaccggctagtgctgttgtttgaccacaccaaggtgaacgtcagccacaacttcaacttgctagctctcagtgattttgattactttgtgactgatcagccactaccggataacctagctactaaaattgcacctgataaacttatttacctttagaggaggatcattaacatgccatcttcactattaactactcaacgagcaatgttagccctgattcaaagcggattagcctacacgactgacccgttcgacaaagatcgctatcaaaagttacaaaccttattgattcaacaaatggccgccgctgccaacgtcgccactgctgacctgacggctgctctaactcaggactctggctacattacccccaaaatcgacgttcgcggcttgatacgccatggtaatcagctactactcgttcaagatattaaaacgaaactatgggccttaccaggcggctttgctgacgtgggctacacgccgactgaaaatgtgcaacgcgaggtgtgggaagagactggccgtcacgtcgcggttcaggggctcatcaccgtttttgatactgctctacgtgtcgatattccccaaccatttcagtattataaattggtctttgcttgtgaaattactgatggccaatttgagcctaacattgaggtcgcccaaacagcctactttacgctcgacaacttgccaccgttgtcccaaaaccggacaaccgaagaacagttggcacagctaatggcatcttccactaccatcacagtcgactaaatgactgctgaagcgccaaaaacatcccgactagcctgtctgctagccgggatgtttttgtttctttatgacgtctttcaatcaagttaggccgctattggcatcaacaattatgaaaaagagcgtcggattaacattaatttacatcaacctagtaattaccattttcacaatatggtggactttaagtcccctatcattacatatccaccaatccaactaaggtttgttgaaaattcagtcgccgaatatgccggggaatgaattggcgaatatcatcatcattaaagcctacttgcaatttattacgaccaacaataattggccgccgcaacaactggggttgttcgcataacagccggagcgtctcattgaatgacatatctggcagcttatcagcaattgcgggataactttgtgaacgggtagaaataatatcttccaatccattctcagttaggcacagaatttgttttaactcactaacagtaggggctgcgctactaaagttcttctcctcaaatgcaatatcatgatcccggaaccattggcgggcctttcgcgatgagttacatcctgcttgcgtaaacaatttaatcataattatttcgcctccttgattagtgtttttattatgataattataacttgtttattattgtagcaggttattcataactttgtaaagacctgaacgaagtaatcgtaaaaaattcattgttttttcatatttattattgtttaaataatataaatgttatacgaatcaccgttgattttcatgctgatcaaacgcgcgcagcaagcgtgacgccagcaaataagccacttcgtacttcaccgtcaactgccacaagaacggcccaagctgatcgtgtgccggggttaaattcgttagtaaattcaagtaacgttgcttctcggccagcgtacactgctttttaaaatagccccagacgtgctgataagccgttgtcaacgtggctttagttggcgtaatttgttcggcttctgctaataattgttggtagcgttcctgttttgcagctgaccaatcattgtgccgagctaattgtcggatggcattataatgctgctgtgagtgtgccatgacccagtacttttggtaagcccaatcttgttgccattgtgacattgctcccatctcctcaatcttttgatgaatttacaaatattgtaccgtctggctcagaaaaatagaaccaatttacattagtacactggtaacagtcgtaagttttgaaacttagcacaaaaatggcgatagcccagttacccgttggtgcaacttagctatcgccatcaaaacttatattttatgagtactactgttgtcaattaaagttgattagccagaactgatgttacttttcgcctggccaagctgagatcatgagctcacgttgcggataatcttgtggatgttccaacatatcggtgatcaatgtcgccaatgagaatagactaagtggcccaccgctaacagcatttccagctggttcaacaattaattgatccgcttcatcattgtacttgaaaaaatgacaggctagcaatgtatagtccaaatcactattcctgatgactgcggccccggccttttgccccgccacataggtcgtctcaacttcacgactaaacccaaactcgcggtgggctaaggtgtacattgcttctgaaatctgatcatagttgatttgaaactgggtcgtccaaaatagccgtttgaccccaactgcatccatcgcttgcaccaatgccgtggcaaactgcgccgcgtgggtaatgcccaccgttgagaatacgacgtcaatccctcgcagcgcgcgttttaaatcatcaacattgctcgcatccccgattaactgcgtggctaacgagacatcatgctcatgtcggtgatgatccaacaaagtcacgtggtgctgcggcatcacggccactcgacgatacacttcataccccaatttacccgttccaataatcaaaatattcattactgatcacgtcctcacatcactcgctaatttattcgtagcaacggccgaaccacaaatgacgccaacagcgcatatccacaccctatggttaatcagttcggtcgcttaaggctcattataccggttccaagatgataattcggtcattattcaaatttaattgtgattcgatgactgattagccttattttgaataacagggtcaatgacagccaccggtcagccatgagtacggacagctattaataactttgaaatagactaacgtcctaccattttagcttggccaggatgaccgaggccccaaagacaatttattatgcccgcagttggctatgaaaaaagcaccgctaagtttggggtaggaaccgatcctaaacttaacgatgcgactcaactctgttcgcgattgctgcgccaactaacgatcaattaccagtttaaccgcgagagctcatccatcattgctgaacgccgcggatattgttgctgccaatcatgtacaatcgcctgcacggtcgatttaccagccgggtaagcaagcatccgtttcaatatgccaaccaattgttgatactttcgccgagttccagtagtagtagccattttccgcacttcatgatcatatttcgctaatagcagatctgaaaaacgtggtttcaataacggctcatagatccgtaaatcccagagtccgtccgcggccacgaccgcttttaatagcgggttcaataagttttcttgcacgtacagtggtttcaaatcgacattggaattcttcgcgatcgctgtcaacagttgctcgcgaaccgccggccaatccgtggtcgggtaactctgcttcaactctgaaaatagcatctcatccgctggcgcatattcagtcagcaattgccataattcctgacgatacagttgttgttcacctaattgctgataaacgtcctttagttggcgactaagttccgctaacatgctgggatcgtccgtgaccaactttttaccatcctttagcaattggaccgcgtgcgcctcatcttgatgttgaagacagaactggctataaaacaagcgaacttgcggtatcgccaagttagcgccacaaaatttaataatttgcttatcaggcacatgagccgcagacatcatttgtaaatagtgctttagccattttttatctgccagtcatagtcccagagatccgggtgtttttgcaccgcacggaaccgcttagcggtatacaccagctttgcatcaataaacgctggcgtcttgaaatatgtgaataataaatcgtcaagcgtatcttcaatgatattcaacgacttcgttaattgtttgcataaccaatcaaacacctgctgctgcacatccgcgtcggcttttgttaagacagcttcccacaagtcgtcactagcactcatgatcatcatgatctcaccatcggaatcatcaatgtcgacgtggtcgattttaagcatcagatgcgctaagatttgaaataccaaaccatactcgccgtgatcgaccaacggttgcacctcttcttttaggagagttaaggcctcatcaccgaagtccgtcgccgcgtcataatcgataaaaccaccgccatccgcgtttgtgtcaaataaatcatcaacactcgcgagatattcaggtaaatctgtcacaacattagtctcacccatgaccgtccggaacagctggacgagatgcttgtcatgggccaacaccacactcaaaaagtcccggacttgccgatcagtagcccgctccaccagcttagtggcagtctgttcaagactgtcgaaactagttggtgctttggaaacttgctgttgactggcaggtttatcagccgccgtcgcttggcacaaaacggccgccatgtgcttgcagtacggatgactattggcatacggacactcacacgcgccaccgtgaaagtcaccattagcgagatcaatcaccacgccatagtcctgcgtgcccgtaaccattgccgtaatttgtgttttggtccgttttaaatcagtgacatacccctgtaagtaataatcgtacccacgttcagcgattgccgttggaaaatagtcttcccagtccatattgtcactcccgttaactcgtttgtcctaaccatactgcggtatggcggattgggcaagacccggcaagcaatttctcaccatatcactcaataccgaccctcatttagcatacgctgtgtcataactttatctgttgacactaaaaagcttgttttttcaccgtggtttgtggctcattggccgcaccaatccagtgaattctcactgtttaactttccgaccgttgccagtgagacgccgtcttatcgaaattagttaaatcccggttttatcttttttacaggtgctataactaataacgccaaataaaatgccttttctatctacgatggcccttacaatatgaagtttatactaataaagcaattgtaaaacatcgtacaatcatactttaggcgccaaattaatcccattaaaaaacgctataagatttcacaatcaggcttaatcactaaagcaaaataccactttaaatggacagaaatgtgactgacttatactacgcgccaaatatcaaattaagggtgtctgataattgatgaatttctttgcttgatgggaagtcatttgtttgtaagtaatatcttatcatccctaacatcatgccaccaataacatttatttccaaatctgactttggatgtgtgagagctgcctgtaaatgattacttaaaatatctttaagaccatccattagttgcatcttagcttgtggaattgccattattgcgtttattggtctgctccaacacatcagtaattgtctaagttccggttctaattgaccaactgcgttacttaagccaattccttgatttatgagtaatcgcttctttttcaatgtctcatcaaaccacgttagaatatcttgtagtattgcgtctgtcagtgcaaatttgtcctcataatgtaaatagaaagttttacgactaatcatagatttgagtgcaatatccgtgacagtaacgttgtcaaatccattctctatgactaggtcaacaaatgatttggtgataacgtcgtcagtttttttcattctaaaatccgtcatatcgattcctccattaccagttttgccaattctgtaaccttatggctcatatggttgccatttgtagccttaagacacaaatcatattaatttgaccatgttttttatttcaatattaatataaactacccgtagcataaaaaaagggggtagtgaaaatgttcaacgtgtttaagagaaaaagcatctggatcagtatgttagtcgccactatattaatcggattatttgccttcgcacaagttggagctaggagcacagttaaggttcgtcatttaccattagcgttagtagtaaacgatacaggaaaagatgctaagaatgttgttaagaaattacgaaaagagagccataagaaaagcgctgaaattaaatgggtcaatgtaacccacacgagtgaactcactaaaggctttgcatccggaaaatactacggggctgttgtcattcattcgggatttactaaagctatcaatcagcaaacagactatttaaaaggtaaaatcataactcagaagctagctgcactggtagttaaaacgccagtggctgctaagacggcaccattccaacaacaaaaggccttagcaaattcattaaccaagaagaccccagaacaagcaaaaatctctttatacgtcagtcaaggaagtaatatgacggttgcaactattttgactactgcacttccaaagatgactgatcatctaaatcagaagatttctaacgaatatataaccgttgcaaataagtcaggactaacactatctcctcaggactggtctaaattgcaaacaccaattcacacaactcttatcaaacgcaataaagtttcaactaaagaaataagtggtatggcgccattcttagtaaccatcttctgttggctcggtagtcttattgctagtttactgaactggcgagaccatagtaagaatgagaagaaacgtactgatggccgcctctcattaactagtgtcacaagccaattaatttcgggtatcgcaattgtcactgcgattgctgtatcagtttacttcttcacaaaagtttgctattctgtgccaattcatgatccaaaacaattcctactgatgattggtggtatatcatttgttttctatctactgcagtcagctgtactcgatttgcttggactaaaaggatggccattactacttattatctggataggttcaatggcagtcattactttcattccgcaaatgctgagtcccttctatcataattatgtttatgatattacgccaattcgctttgcctatgatcttattcttaaccaaatgtatattacagatgcatcaatcactggaccttcaatgttgagcctgctgtacattggtatagcttcaatttttgccatgtatgcatctaccctcattaagaaacggaaaaaagacagcttagcataaaaagacgtacggcttctttaaacctcctgaacccagaaaagacgaatttaaaacatgaatagtggttaaatcaggttgtgtgtccagcatatccctgatttgccattatttaattcaataaatgataatttaggttttgatgaaagatgaaaggggataaaacaaatgccacaagaacaatatcaactaactgatgctaaattggtaaaacatctatttgatttaattgagactggacaaacactcgaaagtattactgtcacagaactttgcttaaagtcaggagtatctagaaaaactttttatcgtcattattcatccacacaaaaagtcattgagggctttttggataattctgcaaatgactttatcgaaatattgaaagaaacaccaatactttgtttaaatgattttatcgacgctcttttcaaattttggtttagcaacaaaaatcgattacaagttttacaaaattccgactttttctcatacacattacatcggttaactgcactcaaactgttggacattgtcaacttaacagaaaattctgattggcaacatctcacttcaacccagcaatccaatttttttaatttttgtgctggtggtttatggcatgtcttaaatactcaaagcatatctatttctgatcttgatacaagtttaattacatcactctttcaaccaaaaaattaatacaaaacaactattgtttattggtacaactaagtttgattctggaacagatttgattatctttcttaatttcacactctactaaaaagaatctacccaattttattaaattaaaaacgctaatcctgattacgtcgcctggatatataattttttaaacttcgcactttcaatcgatgtcaaaagtagaaaaagatatcaatatagtagtagatcataaatattcaaattcattatttaccctctttggtttaaacagttcggcatttaaaataatagagtagcgttcaaatcaagaagatgaacgctactctttttatgctagcccagcataagtgatgagttaattccaccgaatgctgccgacgtgctcaaggcaaatcagaccttcttatgtctgttgctcacgttaacacgcgaaatttgacagttttgtcaggtttgttgagccctatatttgtgggcaccagctaattcatgaccacttcaaccactcctgtaggctccaccatgtgtcctgtaaatttcttagtagaactggttaacggtattcttttaatacagccctaaaccaatttgacagttttgctgccagcaactgtagccatgcgcctcattctaaaatgacagtctataaattcaatcccctcaatttttccaattcacttctttaaataccatacctttcagtgtccatctgtgcccctttagtatggtctgaaaattttaacgggtcggcaaaagtcacccttctgtcaatttctttgaaagtattaggaacaacaatcattctttctcgttcaaaaggatccatgtaaaacgtgtatcgcacgtatcacacatcatggtattttcttttaatacagataccaaaacgtagctaccgcatattgacctagaatatcttcccgcatgcactgtctgtaagcttttgcatagctacgtttatttgagaagttatgcttattcatctgcttaccttcttgcaagatatgaattattgactagaactgcacttgtactttttttaaaataacataaaacagataatatacgaactatttcagaatataaattaggataagtaattaaaggaaaaagcagaaaaaatttctacttttcaatatattgttcaatggccattattatttgttggttctgtggtaagtccgaatgttccgctccaacacccgaaacagttatttgcgtataatgcttaacttgcttttggtaaatatagcgacccgccaatacgctgtacaacggaactaagccgtcattgctataactttgagtgccagctaaagaatacatatcaattgagtttggaatatattttctgtttgcaatcaagttttctaacaactcagtctcacttctaacagaagaatcgttcaaattgtacggtgcagcaatagtcataaccttttgtacagttagataatggctagtcaaattatgttcaagtgcatacgtgataatcagcccaccattcgaatggccaattaatgaaatctttcgaaattcatattgttgtgatatatattttaaggcgtattttaaccagatagcttgtttctttatatttttaaaaccatctttattatcttcaaaagcaataacaataaagggttgtctttcacctttttttattgcaccactataggaaattgtataattcttatgcactaacactcttaacaaagaatgaggtgttttttcccttttattaatgtctcttataagcggatcaaatctatattgtgtcgcattacttcctggaaccaaaactatgggttcagtaactgagtttcgttgaatcttcaaatttgaaatattctgtttagtccatttatcggacaaaaaaattaacgtcataaggaagcataataggcctattgaaataataattttttttgagattcgcaagttaatcactccgtctattatcctctagactcacaaattcaaaatttatcttttaaaagaagatctaattttcgcatgctctagattaattagtctcatctctgctttaacaaacggtaaatatataaaacaagagacaactaagcaaagaagtgctaatagtagggtcggaatgttgcccccagtggcaataaaagctttcaacagtcctgtgtcaacgccgatgtgaaaatgtcgttttttgccgattaaaaaatgctgttttttaccgataaagtttacagtgtctcactgctcctttctttattttgtgcgttgaaacctgataaatcaggtcc

SEQ ID NO: 736 - DNA, 20678 bp, Unknown
  Metagenome-assembled genome
tgcggcgcaggacgcctctaagccgagtgcactctgaagagccttcggagctggcagctacccctcagacagagaagctccgctcgaagatacagaagatcctatggaagaggctggagatatgtaaggatcggacctcactctgtgaagcagtgccatcgagtggcagcatggttagctcgtgtcctgaaggagtccggcttaccatattcacaggagtcccgaccatgttgtactctaccagcatcggccttgacgtgcatgcccgttccatcagcgccgcggcgttcgtcttcgagacgggcgaggtcgtgcagcgcacattcggctacgaccccgacgcggtcgccgcctgggcggccacgctgccgcagcctgcggctgcctctacgagagcgcccccgggcttcgacctgcagaggaggctcgtcgctctcgggctgccctgccacgtgggcgccgtctcgaagatggtgcggccctcgggcgaccgcgtcaagaccgacaggagggacgcccatttcctctcgaggctgctgccggtgcgagttcgtcgagtgcgcccctcccacgctcggccatggaggcggcgcgcgacctgtcccgcgcccgcgaggaccgcgctaggcgctgatgaggcgcgccaccgctgtcaagttcctgctctcagaagggccacgtgtggccgaagggcaggtccgcgtgaccaaggtcggcacacaaacgagtgcggggggtgctgactcggcgagtcgagctcggacgacccgggggcgagcgtgctcggcgtccgagggtattcgcaggtacgtggagtgcgaggagcacgccgcgacctgctctagactcggcctcgcacgaaggaggtccggcgcatcgacccctcgccgggtcccccccccccagcctccgaaccacgagctccgcgccttcgacggcgtctcgaccgtcaccgccttcgggatcgccgtcgagatcgcgacttctcccgcttcgcagccccagcggcgcatagttccgtacgtcgcctctgccgtcggagtctcgtcgggcgagacgactgaggggcaggatcaccaagaccggcaacccgcacgtcagcggctcctcgtcgaggccgcctggcaccacgccaggcccctgtcgccggcctccgaaccgacgtgcctcgtcggcggggctcccggcggaggcggcgggattgcggcgcgggccaaccgcaatgctgcaacgcaggtaccgtcgaccttaggggcgagggaagggcggtccaacgtcaccacggtcagccatcgcccgcgagctcgtcgtttctgctggcgccgtcgcccctctgcgggtgagctgcctgagtctgacgaaaccacccatcccgcaccgcgcggcggccggggagcgcgtggggcaccccgcgatcggagactatgcgcagcgagccaggccctcgccacgccgcgaaccctagacagcggagtccccgccgaagcgtcggaatgctttagccacaccgcgtatcagacttgcagtcttgcgtcgaaccagacacgccctgagcgccgtcgccgcgggaggtggcctaagaaaaggcaggccgtccccgaggaagtctggaggcctggtcctgcctttgcccttgacacagtctatctacatatcagtccctcgtcctccgcttcggctgctgccctcttccgcctctgcagctgccttctcctcgcggtactcatcgaccaccttgcgtgccgctgggaagagccaagcctcctcttctggcttcgtgtcgatctgccctcggcattcttcctgcttcgactctcagatgcaatgatgacgccgagtgacgatgactgcgatgcctgcacccatgatggtttcctttcctatgcatgcatgctgaccactgtagcacgaggctctggccaaagtatctctgactctcccatggccagcccattccgatagtgcgcagcctgcctcttgccttctgccatcgcatggaaagtgtcagaacggtcatctgagcacctggacagggagcttccagcgaaaagagatgccaatggcggaactcaatgcaggaaggttccgatgcatcgcacatactggagtggtggagatgcacatgcttcgacatgcgcgtcagaagggaaggcgtgctatggatttcctgaagggttcctctgggcggagcgaaccgcgcaaaccatgcgagggtggctggaacgagggaggacgcggtcttgcgaacgtcgatgtcgcacctgctggtcccgatcgccgggctgtcgtctcgggcgagaaagaaaatgctcgtgttcgacccacccccccgccgaacgacaccacttctctcgcgctacatacgcacacctcttcgcgatcgagcttcaccgacacgttgcaccgcgcctcgacgtatcgcctcttcgctgagcttgcttcaagactacctggccccttgctggtcgaggatcttccctgagggggatgaagagcagccgaacgaggaaggccttgccttctacgaggatctcttccgcttctgccaggagcatggcatagagccgctgtgtgacaatcacgcacttcgactgctcttcatccccctcagaaggatgagttatcgaagggatgatgtcgtgtggtgtcgttgtgttttaaatgtagtagaggagctagtggggggggaggattttcttagtcctcagcaggcaatgaggcagcggtacgtcttgaagcccatctcagcgaagagggcgatacgtcgcggtacgtgtggtacatgtcgatgccggtctgtgccggatagtagtggtcggcgtcgaacccgagcattttcttctcgccgagacgacagcccggcgatcgggaccagcaggtgcgacatcgacgttcgcaaagaccgcgtcctccctcgttccagccaccctcgcactggtttgctgcggtcgctccgccccagaggaacccttcaggaaatcccatagcacgccttcccttctgactggcgcatgtcgaagcatgtgcatctccaccacctccagtatgtgcgatgcatcggaaccttctgcatctgattccgccatctggcatctcttttcgctggaagctccctgtccaggtgctcagatgacacgttctgacacttccatgcgatggcagaaggcaagaggcaggctgcgcactatcgggaatgggctggccattgggaagagctcagagatccctgccagagcctcgtgctacagtggtcagcattgcatgctagaaaggaaccatcatgggtgcaggcatcgcagtcatcgtcctcggcgtcatcattgccatctggcagagctcgaagcggaagaatgccgagggcaaatcgacacgaagccagaaagaggacttggctctcccagcaggcacgcaaggtggtcgatgagtaccgcgaggagaaggcagctgcagaggcggaggagcagcagccgaggcggaggacgaggactgatatgtagatagacttgtcagtggcaaaggcaggccagcctccgacttctcggggaccggcctgcctttttctatggccacctcccgcgcgacggcgcccagggcgtgtctggttcgacgcacgactgcaagtctgatatccgcgtgttggctaacgcattccacgcttcggctggggagctccgctggtctaggtcgcgcgtggcgaggcccgcctcgctgcgcatagtccgatcgcggggtgccccacgcgcctcggccgcgccgcgcgtgcgggagggtggtttcgcagctcggcagctcacccgcaggggcgagcgcccagcagaacccgacgagctcgcgggcgatggcgacgttggtgacgttggcgcccttccccctcgccctcaggtcgaggtacctgcggtgcagcctgcggttggcccgcgccgcaatccccgccgctccgccggagccccgccgacgaggccacgtcggtctcggaggccggcgacaggggcctggcgtggtgccagcgcctcgacgaggagccgcctgacgtgcgggttgccggtcttggtgatcctgcccccgaggtcgtctcgcccgacgatgactccgcgccaggccggacgtaggacatgagcgccctggggctggcgaagcgggagaatcgccgatctcgacggcgatcccgaaggcggtgacggtcgagacgccgcgcagggcgcggagcctggaggtacgccggcgaggtcgtcggcgccggacctctcggcgatggccgagtcgaggcggtcgcggcgctcctcgcactccctgacctgcgcgacgtactcctcgagcacgagccgctcgcacgggtcgtcgagctcgatggagcgcagccactcgcggtgcccttggtccacgcggacctgcccttcggccacacgtggcccttcctgacaggaacttcgacagctggtggccgccctcatcgcgcctcgcgcgcgtcctcgcgggcgcgggacaggtcgccgcgccgcctccatggccacgtggaggggcgcactcacgaactcgcccacggccagcagcctcgagaggaatgggcgtccctcctgtcggtcttgacgcggtcgcccgagggccgcaccatcttcgagacggcgcccacgtggcaggcagcccgagagcgacgagcctcctctgcaggtcgaagcccgtggggccgctctcgtagaggcacccgcaggctgcggcagcgtggccgcccaggcggcgaccgcgtcggggtcgtagccgaatgtcgctgcacgacctcgcccgtctcgaagacgaacgccgcgcgctgatggaacggcatgcacgtcaaggccgagctggtagattacaacatggtcgggacctcctgtgaatatggtaagccggactccttcaggaccgagcctaacccatgctgccactcgatggccactgcttcacagagtgaggtcccgatcactctacatatcgtctagccctcttccataggatcttctgtatcttcgagcggagcttctgtctgagaggtagctgccagctccgaaggctcttcagcagtgcactcggcttcagaggcgtcctgcgccgcatcttcagcatctgcgtgtgcatcttcgccgagcgtgagtgtggcaagcgtctcttcaacggtacgtatgcactcgtcggtgtgcttcattacgtccttgctccagaagtggatgacatgccagccgctctccgtgagctcggcatccacttcctggtcgcgctccatgttgctcttgatcttcggcagccagtaatctggatggttcgagtgcttgagctgctcctcgaggctctcgtacttcttgctctcaagccctccgtagaatcccttcccgtggaagaactccgagtccacaaagatgcagagccggtatttcgtcataacgatatcaggcgagccaggaagcttccggaaattcttgcggtagcgatagcccctgtgccagagctccttcctgagcaggacctctggcttcgtatccttcccatggatcttggacatgatcttgctccgcacttcaggggagaccgtatctgccacagatgctcccctcgacgcgtgcaggacacagacccaaagcctcagggcacgattatagccaagccccgtttcctgtcagatcctgggctctagctcagatagaggagctccaggagcttcgtgcctgtctgcgtcctgaagatatggcgcttcgcctgctcggctgcatgccttctcgcttctgcattgtctggtgcatcctcgtagatgttcacgaggaagtctgcctcgacgaggatctggtagtctgcgccctcgatattcgcatacgtatggtgatgggcgatgagccagcagatgcgctcaatggcctcaggtgcatattctgccttctcgagaagcggtcgtgctacgccaggccccagctcctcctggtgcttgccgcccgcatttccatagacccgctccgactcatggatgccggcatcatgcacgatagcagcagcctcgacgatgtagcgggtcctctcgtccacaccttccgcctctgcgatatcgcgtgcgaacgtacggaccttcgcgaaatgatggatgcgcttggaatcgcccttgtcgtattctgccatcgcaagctcgagagctgcatggctcttgggtccgagtgcttctatatcttctgaagacatattgtctcagcccttctgcctgggttccgggaatcagtcgaagctagccctgcgccggagcttcttgacctggcttcggcgtgcctttgcatcgagcctgcgtgcaatcgaagcctttgtcggcttggtcttcttgcgcttcttcggcctgcgcgcacgacggacgagctcctcatggatcttctcgaggcagcgctccctgttctggagctggcttctcgactcgcggctcacgactgtgatgccggtcgggacatggatcatgcgtacggcagagtctgccgtgttcacgccctgaccaccggggcccgaggcatggaacgcctcagcatggcactggcgggcaagctccttgtccggaaggcgtgcaaagcgcgcatattcctcatggctcagatgtccttccatgctcatgctcctctccctccgccacagcagctttctggatgatacccgcatgcacctccatgccgccgaaaacagaaagaacgtcgcttttctgcaacatgtctgccggcggcagggacacgtcggaaacggacacattcagacgtcagacaggcactgagggagccgcaccaaggtgcagctccctcagtgcctagaagtcggtatccggccagacgaagtcgaaagatcccgcctctcccccgtcgatcaggaggttctgtcctgtcatgaaccggttcgtgaccgcgacgaagtagatccattccgctatctcttgaggagttgcccagcgcttcaggggcgtgagctccatgatgcgcgaccacagcgtctcgtcttccatcacagggagattgagatcggtcagcactcctcccgggtcgatgctgttgcaggtggcctggggcgccacccgctgcgccaggttctttgcataggcaaggacgccgcccttcgaggcagcataggcaggaaactcggcacccgtgtgtccgctcgaggagccgaccagcacgatcgcctcgagctgcggtgctgccttcctgtccttgaaggcataggtctcgcagacattgagcgtgcccttgaggttcacgtcgatatcatcttcgctcgcctgcacgccggcattgctcacgatcacattgggggcaaggtccttgggcagaagatcgcgtcttctgacatctgcgatgagatgcgtgtagcagggatgcccgatcgtggcaggagcgatatcgaggccccagacctcatgtccccgctcgaggaagagctcggctgctgcccgcccgatgcccgaggaggtgccggtgatcagcaccttgagcgagcgtccaccatgatcgagggggaggctccttctctcaggcatgctgggcctccggcgtctggcgcacttcgggatggagcgcaagatactcttctcccacaccgtcacgttcccagccctttacgacacggaagcctacaggcgagaggagcacctcgcagaggagctccatcacggcaccggtgagcgagcaggcaatgacctgtgtccaggtccacccgaagaagttgtggctcacgatagcggcaaagacgaagttgtccacgaactggccgatcagggtgctgacataggagcggatagcaaagctcgcgaagttgttcttcctgagcttcctgccgatgctgacattcaggaacgagtttgcgattgacgagcagaccatagcgcaggacgagccgaagaccacataccagctgccagcaaatgtcgcattgagcgctgcgttcacatcgagcgaaccgtagctgtaataggcaccccacatgcccggcgtcaggctcatgagccagaacaggatggataccgcaagattcacgaggagcgccaggatgctgaccgtgaccgatgccttggcgccgaagcgcttgcagatcatgtccatgcagaggaagctcacccagctcacgcagaagccgcagtcgagcgcgaggtacggcagcgagatgagctccttgttcgcaagcaggttcattacaacgacagcgaccgtgaagagcgcaaccgtcgggctcggaatggaacggagcaggacgcggcaatcttgaagcgttttcttgagcatgagatatctcccggttttggattggcaagcaggtttctacctgggactgcttggagggccgctctcggccgcagaacatggtagcaaagagggctctctatcacacggaactccagaaaaaggcctgaaagagcattgcctgtaccagagccagagccttccggcatcagcagacagaatgcaggctcgtatagaatggatgcgtccacaacgcaagagaaaggttgagcatggatacagaagagaagaccgaaacagcggagaacgttcaggccgaagcggctcctgaggacgctgctcctgagaagacggcagaggccccttcgatcgagccctttgccgaggaaatctcgttcgatacatttgccgcatccgatatgcgtgtctgcaaggtgcttgcctgcgaggccatgaagaagagcaagaagctcctgaggttcacgctcgatgatggatccggcaccgagaggcaaatcctttccggcatccacgcctactacgagccagaagagctcgtcggcaagaccgttgtcgcaatcgtgaacatcccgccaaggaagatgatgggtctcgactcctgcggcatgctgctttctgccgtccatgaggaggatggctccgagcgcctctccctcctcatgctcgatgacaagatccctgcaggcgcaaagctctgctagctcccaagctggagaagcgcaatgagacgtttccgccatcttttgggagccatgctctcctgcatccttgccctccttctgactctgggcacctgggcctgcagcacgccatctgctgcaccccaggatgctcaggccacctcttcagcagtcacggtccaggtcgagcatggctcttcctatacaagcaaggaggaggtttgtgcctacctccatgagtacggagagctgccgccgaatttcatctcgaagacgaaggcgaagaaggcaggctgggttccctcggaaggaaatctcgacgaggtctgcccgggcatgagcataggcggctctgtcttctgcaacgacgacggaaagctgccagacgccgagggcaggacctggcatgaatgcgatatcgactacgatggaggcatgcgggggcctgagcgcatcgtctggtcgaccgacggcctcatctactacacatccgaccactacgagaccttcgagcagctctactgaggaagaccgatgaagatccggatttcagaggcagacacgcttgccccagacgacgtctgggaccttctgtctgagagcttcggcttcccctcctggttcggccgcaactttgcagcgctttctgacctcctcgaagatgtggcagttccagccgagctcgagatcgtcctggacagccaggatgaagacctcgcccggcaccgtttctttgcaacgcttgccaaggttgcctcgcgtgctgccgaggagaatccgaccctccaggtagcgatatatacggtctgagaggagtttctgccatgatcgaaaagcacggcatgtggtatgcgccgcacgaaggcacaaggacactccacatctggcttcctgatgactactacgcagacggaaacgaggagcgctatcccgtcacgtatttcttcgacgggcagaacctcttctctgacaatgaggcaacctacggcacgagctggggcctggcagatttcctccgcagctgggagaagccgatgattgtggtcggtctcgagtgcagccatgtcgtaaacgagcgcctcgacgaatactgtccctggagcctgaagatcatggacttcgatgtccacgggatcggcgagaagacgttccagtggatcgtgaacgacataaagccctgggtcgatgcgacctatcgtacctggccgcaccgcgaagcgactgccatcgcaggatcaagcatgggcggcatcatgagcgtctacggcgtccttgcccacaacgatgtcttcagcaaggcaggctgcatctcttcgggctgccatttcatgaaccgcttcttcgtgcctcttgccaacatctcagacatctctcctgatacacgggcctacttcgcctgggcagagggagagtccggcaagatctggggagaggatctcctcgaagattcggatgaagccgcagccacgcagaggcttgccacaatccttcgcaatgagggagcggcaacctcgctctggtgcattccgggagggcagcacaacgaggcaagctgggcgacgcagaacaggcgctgctccgatttcctgtggtgtgcccgcgaggatggaccagacgaagcctgagcaagaacctcagacagtctatgcaggagggagccaggatgttcagcccgtttcgtgacgagcaggggcatgagaaggccctgagcgatgtggcatggggagaccttgcccagctccaggagctcgaggaaggctttgccctcgagttcaagcagacattcggcccttcagtgcgccgcaagatcccgaagatcgtggcctcgttctcgaactcccatggcggatggctcatcatcggcattgccgacgattcccgcgaagtctgtcctttgcccaaaggctctgccgactactcccagatcataggcgagctctgccgccaccatgtatcgccggcaccgcgcttcgaggtgcgcttccttgccaatccccagaatccagagaccggcgtcgtacttgtccgcatcgacgagggcgacttcccgccctatgtcgccgacggcattgtcgagatcagggagggctcgacctcaggccctgccgactcggcagcgctggtcgatctctacgacagagcgatgaggagaaggcaggaagtcgagcgcttctgcaggcgcacggtcttctatccgatggcagatgatgcagctgatgatgcagcgctcttcgacctctatcttttccatatgggaccagcggcagaagatgtccatgcccgcacccgcgtgaacgagggcgctgccttcatgcaggaagcctttgcccacaacggcgtcgagtgccacgtccagcatgcccatgacagcctcatcttcaggagctcccaggcagacgatatggtcgtcccccactctgccatcgagctcttccctgacgcatccatgaagctttcggtccctgctgtcatggtccgcggcaagaagcgaaagagtgcgctcaagaccctgcgggaaaagacgggcgcctcgcttcctgatgatgtccgcctcatggacgcatcggcggcactccagcgcgtgacgaggatggcatcgctccttgaccgcttcgtgcgcctttcgggcctttcctggcaggaatatgctgtagcatacgagctcgagcacatggcaggcgtgacgctctggtcgaaggatccgacctatctctcctacgcaaagacgcacggcatcctctggtgcgcaacggcagactgcctctcgcgcgtccgctatctcgatgacggggcacacgacaccttccgcgcccgccagtttgccggcagccacttcttcgaagcctgcggacttccgcttggctcgcctgactcggaagacactgctctcgtccaggcgctgctctcgacaagccaggacgaggaggcgcaagagcccaatgaagagtgagcgcctcgacgcgcgatttcatggagaaggaacgaaaggcagcgttcgtttaacaagcctgtagttatcgtgcgctaccgtatcccccaaacttcacaagagcaaggagcatggcatggagcgcacggcccgagaaggctacctcaatatcctgaagcgcgagctcgtctgcgcgcttggctgcacggagcccattgccgttgcctatgtggcggcgctggcgcgtgacgccctgggcacagctcctgagcatctctccgttgcctgctctggcaacatcatcaagaatgtgaagagcgtgaccgtgccgaactccggcaaccagcgtggcatcgaggcagcagcgacgctcggctgcgtcggcggcaaggcagaggcagcactcgaagtcctcgaaggcgtcacgaaagatgagcaggagcgcacacgcgagcttgtctcctccggcttctgcgatgtatccctggcagaggatgtgccgaacctctatgtccgcgtcgtcgcgacaggagaaggccatgagggtgtggcctgcgtctcgggcagcattacgaatgtcgtccgaagctcgacacggatgggaaggcagtctcggtcgacggcgtcactgggcaggacggtgggctttggcggtgcgaggctgcgcaagaggacgcagagcagagccagatcttgcctgcctctcgctgaaggcattggagtttgtccatacggtcgacattgccgacatcaaggacatgatcgagcgccaggtgacgctcaactgaggagatctcgaacgaagcctcttcgggcgactgggcgccgcatcggcaaggaccctgctcactcaccctcccgacgatctcctgccgtgcactcgctgcgcgcagcggcagggtcgaccaccgcatgagcggcgtcccatgcctttcgtaatcaatgcggctgggcaccggcacacgtgtcctgccctgtccgcaggcatacgacacgcttcctcaagtctccccgacgagatctgcgtgcgtctcactctccgaccttaccgccatcccatggcgaagcgcttcatcggcgagcttctgcttctgcggccgctgtgaccgcggcaaccggtgctggcgctgcacatctctacctgtaggggcggctccttcggcagtaccaggcaacgattgcacataccgtgcaatgtgggcgcatcgtctgcgaacggagcaaagccgcagctgtgctgcaagatcgccgctgcggtcgatgcccgccattacctcggccggcgacaggcatgacgaatgtcgacttcatcccggatgaggcgctcatcgcgagacgacggaagagacgatcctccatgggatacgtcggaactgtcggcatgtcaatcccaccgacgtcgagatcctgaacatcatgattggaaagacggtccgccagaactcctgaggctcaccgcaccgcgtggcagagcgtagggcctgggcggtcgagcttcgtgccgtccaggctgggtgcactgccatcgcgcccgtaggctgtgggggcaaagccgtttctgaaggccttccccggcctcggtccagcacgagacgatccctgtgtctgcgatctgcggcagacagaagtgattgcatcctgcatggcagaatggagcagggcacaagcgcagcaagacgcgggcatcctcgcagaatgccccagttcgagaggacaggcacccctttctgtgccagcaccagagaggaagcctctgcacgcttcgttcgagggatgtccggcgatgccacagctgccgtgctcatctcctggagcccaccacgaaggcatacctcctgcccgagcgaggcaagcgtctggcttccaagcttctgtcttcgggttcagctgtttcggcgagacgtgaccctcccgcgcgtgcacctcgacctcgcaggaaagctcctcggcagaaagctctgaggccattggacccgacgtgaagctgtttccgagccatcagatgcggaatgtatcggagcgatccctagaactcccgccttcccgagaagaggaccgacatcggtggcgcaatgtcccctgccagcgccacacagtctgcctcgccttcacaccatgcgtcttcccactggtttctcgagcatacctggcggacctcatgcagggcccaaaagcggcccgatgcctcttcggcgcttccttctcccgctcttcctttcggagtcagcgcttgggcctcgtcgagcgaggctcccgagcaagagcacgccagttgagctatcgacgtccggtaaccagagcgctcgttgggcggttccattcatcggcagagcttcgagatgcgcggattagtcacgatggcctggaagagcgcaaggccaagcgtgtctccggccgagcttttcatgggcggtcctttttggagcgccaagaggattttcgaacaatcgtcagctgcagtgccttcaggcggccaagccgattacccgacgaaccgtcgagggtacgccgtcgaggtcttacgactatcggatatcccgccgtcgttcacatgacatgtctgaggcagacgcccatgagctcgtcgtgcgcgacgccttcgaggtgcgctcgatgcccctcgaacgtacgccccaccatcggtccaccttccctgccagtggtctcgagcagcacgcgagcttcttcccgtgcgcgagcccctgggtgaagtgcctcgacgatgaggaggatctttcatctgctccctctcttcagatggttgccaggatggaagttgcggtgtgcccgggcagctcttccattgcgttcgatacggaggcgaagcctcgcgtgtgtatgtccacgacatccggcttcgccgagcagattcatcgtataggactgcgcacgagctttccgaactggtggcgctccataagatcgagaagtgcctgcacatctgccggatcgggcaccttgccccttgccaccccggggatttccttgtaaaagagcctaaggtatttgcgcgatctcgctcgcgaacttccccgatcgcctcatagcctttgcaagtcgagagatggcagcctacgtgatgtcgccgtgaatccagcctgcctgtccagaatgttagcacagcgattcttgcccatgtaggacaccagccctgacaaagagcagaaaaggctgcagtatgccgcatgcatccaccctacatagcaaggcagcccggaacgctgcacgcggacgcctcaagctctcattggaatggcggatgacctagcggcacacctcgcgtgccgcgatacgtcctgccgcaagagccgatgaagcccacccagcccgcggacccaccacccccccgcccgcgcatgccttcatcaggtcgaaagacgatcgaagggtcgacaccctgccgcgaatgcttgcgcaggagagatctgagcgacaagcaccagcttgcccagccggcaagatagaccgccgctgtcatacccacaagaagagaggaacaggaccggcccacacgggaagccgcgtcttcgaaagcgggagagaagatacggatcctgcccaggcgcggcaatgaagccgaggataaccctccggtgggggggggggaaaacatgccagacgcagacgccgccaaggccgcccgcgaagaccgacccgagcgccctgccgcgacataggccggccggcgggacagatgccggcctccttcggcttcagcgtcgcagcaatgaagcaagcggcagatctggagcgtgaagggcgcacggctgaagcggaatctcgaggatttgcgctgagcggccagagcaagagctctccgtcgcatatgcgcaagcgcctgcctgcgcgctgctgccctgcaccaggctgcgcagatgcatgctggcagacgatttctcgagggcatcatccgttcgttctctttgcatatcattcctttcgaccaagcgggcagggaatgcacggatagcaatagcaaaaccgcctgcagcctgctcgtgcagcctctcgttcagggaacactctctgtagtacctgattgacctgagaaggggccaaaagtatccggaccctcgctatgatgttggcgcacaaccatcataggcggagggtccggatggactttgactctcacaggtcaaaaggcatcggagattcctgaacgagaggctgcacgagcaggctgcagcgggttgctatgctatccgtgcattccctgcccgatgcgtcgaaaggaaatgatatgcgaaagagaacgaacgggagctcctcgagaaatcgtctgccagcatgcattcgcgcagctggtgcagggcagcagcgcgcaggcaggcgctttgcgcatctgcgcgggagctcttgctctggcgctcagcgcaaacctcgagaccgcttcagccggtgcccttcacgctccagatcctggcgcttggcttcattgccacgctgaagccgaaggaggcggcatctgccgccggcgcctatgtcgcggcaggcgcgctcggtgtgctcggtcttcgcgggcggccttggcggcgtctggcgtctggcaggtcccaccggaggcttcatcctcggcttcattgccggcgcctgggcaggatcgatcttctctcccagctttcgaagacgcgccttccctgggccgcgtcctgcttcctctctcttgggggtatgacagcggcggtctatcttgccggctgggcacagctggtgcttgtcgcgcagctctctcctgctcagcattcgcggcagtgtcgagcccttcgtcgtcttcgacctgatgaaggcaggccttgtggcatggctcttgcggcaggacgtatgcggcacgcgaggtgtgccgctaggtccatccgccatatccaatgcagcagacagtccgggcagaagttccgggctggctttgctatgtatggtggaatgcctgggcatctgcagcctttctgcttttgcgggctggtgtctcatggcatagaatcgctgtgcatacatctggacaggaaggtgctggattcatgggcgacatcacgtaggtgccatctctcgacttcgaaaggctatgaggcgaggggaagtgcgcgccgagatcggcgaaataccttcgccttttacaaggaatccccggggtggcaagggcaaggtgcccgatccggcagatgtgcaggcacttctcgatcttatggagcgccaccagttcggaaagctcgtgcgcatgctccctatacgatgaatctgtgctcggcgaagccggatgtcgtggaatacacacgcgaggccttcgcctccgatatcgaacgcatggaagagctgcccggcaactacctcaacttccctctggcaaccatctgaagcagggagcagatgaaggcatccgcctcatgtcgaagggctcaaccaggtgctccgcgccggacagaagacctgcgtgctgctcgagaccatggcagggaaagggaccgaggtggggcgtacgttcgaggagatcgagcgattcgaaggcgtcggagcacgacgagctcatgggcgtctgcctcgatacctgtcatgtgaacgacgcgggatatccgatagcggaagacctcgacggcgtcctcgacgagttcgatcgggtaatcggctggacccgctgaaggcactgcatctgaacgattcgaaaaattctttggctcccacaaggaccgccatgaaaagctcggccagggcacgcttggccttgctgccttccaggccatcgtgacgaatccgcgcatctcgaatctgccgatgatactggaggacgcccaacgagctctctggctaccggcgcgagatagctgcacatgcgtgctcttgctcggggagcctcgctcgacgaggcccaagcgctgctcgaaacggaagacgaggagaaggaagcgccgaagaaggcataggggccgcttttgggcccctcatgaaggctgccaggatgctcgagaaacgtgggaacgcatgtggtgtgaagggaggcaggctggtgtggcgctggcaggggcattgcgcagaccgatggtcgctgtccatcttctcgggaaggcgtgaggttctatggatcgctccgatacattccgcatctgatgctcggaaacagcttcacgcgggccaatggcctgccagagcttcttgccgaggagctttcctgcgaggtcgaggtgcacgcgcggggaggggcacgtctcgccgaacagctgaacccgaagacgaagcttggaagccagacgcttgcctcgctcgaggcaggaggctatgccttcgtggtgctccaggagatgagcacggcagctgtggcatcgccggatccttcgaacgaaggtgcagaggcttgcctctctggtgcgggcacagaaagggtgcctgtcctcttcgagacctgggcattctgcgagagatgcccgcgtctgctgcgcttggcctcgctccatctgccatgcagaggatgcaatcacttctgtctgccgcagcatcgcagacaaggatcgtctcgtgctggccgaggccggggaggccttcaggaaacagggctttgccccaaggctctacgggcgcgatggcaggcacccagcctggacggcacgaagctcgccgcccaggccttgcctctgccatccgcggtgcgtgagcctcaggagttctggcagaccgtctttccaatcatgatgttcaggatctcgacgtcggtgggatgcatgccgacacgtccgacgtatccatggagcggatcgtctcttccgtcgtctcgccgatgaggccttcaccgggattgaagtcgacattcgtcaatgccatgtcgcgccgaggatggcggcatcgaccgcagcggcgatcttggcagcacagctcggctttgctccgtgcagacgatgccgcccacattggcaagggtattggcaatcgttgcctggtactggccgaaggagccgcccctcaggtagcagatggcagcgccagcaccggttgccgcggtcacagcgccgcagaaggcagagagctcgccgatgaagcgccgcggatggcggtaaggtcggagagtgcgacggcacgcagcattcgtcgtgggagaccttgaggaagcgtgcgtatgctgcgacaggcaaggagcacgtgatgccctggttgcccgagcgccgcagttgattacgacaggcatgggacagccgctcatgcgggcgtccgaccctgccgctgccgcagcgcgtgcacggcaggagatattgtcggacgggtgaggagcagggttctgccgatgcgggcgccccagtcgcccgagaggccttcgttcgagatctcctcattgagcgtcacctggcgctcgatcatgtcttgatgtcggcaatgtcgacgtatggacaaactcccagatgccttcaagcgagaggcaggcaagacgggctctgcttctgcgtcttgcgcagcaccttctgcaccgtgacgccgtcgaccgagactgcttccatcacgtgcgagctcgacgacatcgtatgcctgcccgagacgcaggccacaccctcatggccttctcctgtcgcgacgaagcggacatagagggcggcacatccctgccagggatacatcgcagaagccggaggagacaagctcgcgtgtgcgctcctgctcatctttcgtgacgccttcgaggacttcgagtgctgctcctgccttgccgccgacgcagcgagcgtcgctgctgcctcgatgccacgctggtgccggagttcggcacggtcacgctcttcacattcttgatgagttgccagagcaggcaacggagagatgctcaggagctgtgcccagggcgtcacgcgccagcgccgccacataggcaacggcaatgggctccgtgcagccaagcgcgcagacgagctcgcgcttcaggatatagtaggtagcttctcgggccgtgcgctccatgccatgctccttgctcttgtgaagtttgggggatacggtagcgcacgataactacaggcttgttaaacgaacgctgcctttcgttccttctccatgaaatcgcgcgtcgaggcgctcactcttcattgggctcttgcgcctcctgtcctggcttgtcgagagcagcgcctggacgagagcagtgtcttccgagtcaggcgagccaagcggaagtccgcaggcttcgaaagagtggctgccggcaaactggcggggcgcggaaggtgtcgtggtgccccgtcatcgagatagcggacgcgcgagaggcagtctgcgtcgtgcgcaccagaggatgccgtgcgtctttgcgtaggagagatagtcggatccttcgaccagagcgtcacgcctgccatgtgctcgagcctgtatgctacagcctattcctgccaggaaaggcccgaaaggcgcacgaagcggtccaggagcgatgccatcctcgtcacgcgctggagtgccgccgatgcgtccatgaggcggacatcatcaggaagcgaggcgcccgtcttttcccgcagggtcttgagcgcactctttcgcttcttgccgcggaccatgacagcagggaccgaaagcttcatggaagcgtcagggaagagctcgatggcagagtgggggacgaccatatcgtctgcctgggagctcctgaagatgaggctgtcatgggcatgctggacgtggcactcgacgccgttgtgggcaaaggcttcctgcatgaaggcagcgccctcgttcacgcggtggcgggcatggacatctctgccgctggtccatatggaaaagatagaggtcgaagagcgctgcatcatcagctggatcatctgccatcggatagaagaccgtgcgcctgcagaagcgccg

SEQ ID NO: 737 - DNA, 14407 bp, Unknown
  Metagenome-assembled genome
ggaattatccttcttttaataaatgctctttcattcgatatgatcgacagtgatggagaattgcgtgcgccccaagcgctctaaatggcgtagcacattcttatatgatgaaaggcggtccacacttgaaagcggaatatagtgataaatggttgattccgttgtatcgtattgcaagtcacgcaccaaatcttagcggcccctgatccattggacgataaccaatatcaaaatgattgatgaagttgaaacacgggaacggcgtagcactcttcgcctcccggcattgaattgtctgtttgacgtctgttgtgaggtcgctacactcgaataaaactgcgttgaaattcatgttttacccccttcaatccaatggcggtgaaaggtgagttaccgaccccggcttgggccgcccaccaaaagtttgttatctgggtgaatcttgtgagcaagtcctccaattacccttggttaattcccgggtgtataataaagtcaaagtagttccgtttgtattatgggaaagcgggatagtttaattccaaatatcttttttggtccggtatttaagtcagccgtgtcaattctgaaatacgatcctccaggctttggtgcttcccttgtgctcccagactacacccggtccgccttaatcgcttgcgtgctgccttccagtctgactagatcgatattctactttgttaaggttgagccgtctgtgttacctcacaagatgctggcctctgcgcggctcagagtggtcgttgcagccactcttccacctcctcttcacccattcttatgctgttcgccgctcctgtttaccccttccgtcattcttcatccactgcctctgtgctcatgttcacgcatattgttgtataaaggtctgacggacaatctctccagtcatccggcgaaggttagtaaatttctttcaggcactaaagggtgagcaaacgcaatgagttctcgttctaagaaattcatagagtctagtcatcgtgtttatttggtacggtttcgggcatacttagtggggaaggagtattttgttccgatttggaaagacatcttgatttgccgctgaccttgcgctggttgtggctggcctagcatcgagtagtcgtgaatcaaaatctggagaactcttttctttatcaagcaatgtaaaaaggcggatttgagtcgcctgagattctctgcgattcgcctgatccatcaaaaatggcgatctacggcgaagtgctgagcgggcttcaaactcggtggttgtcaatttgattcggctgcaggtagttctggccgcgcctcaacctttcctttgtgtttgtggccgaaacggtcgacaagcttggcttggaaccagctcgcctctctattccacgaaggttgtccattaacaccggcgtaccaacttacttttatgtatatcgacgcacacctttttggttgtcaaaccatgcttttctttcggcacaccccggttgccacaaggcattgttacgcctccagaccatacgcgtatccattggtcagatggaaggtgacagtgcatgtatgtgtgtcattacgcggtcgtaccccatgatgcaaacacataaagaagcggataactgcctgtattggtacgacaatctctgcctctgaaccggatgccttggacctgatttatcaggtttcaacgcacaaaataaagaaaggagcagtgagacactgtaaactttatcggtaaaaaacagcattttttaatcggcaaaaaacgacattttcacatcggcgttgacacggatgagaccattggtattttcgttggtcccacgttgttgtggtgcgtgcgggtctggaaaatagactgagataccaagctctttaccgacttcacgataacccgcaaactctgtacctcggtctggtgtaagcgtacgaacgcgtttaggtgtgactgtatgcaggaggtcgatcatcgcttgggccacattcttggcattcactttgggtacacgctcagacagaaggtatcgtgacttacggtcgaccagtgacactaaacccgaacgcctgatcttgccgcgaacggtatcgccttcccaatggccaaaacgagtccgattctcacatgagactggtcgttcatggactgatgggacattattaaaacggccacgtcgttcgttgacagttcctttaaccttacgagttttcccacgatgtcgtaactttcgagcgaatcctcgagtcccatgacttttacgtttaatgcctaaattatttcgttcaattccgcgataaatcgtgttgtagctgatatgccaattactgttctctaaagataaacgaccggcgatttgctcgggtgaccattgccgttgaagaatgcagtgaaggacaaagtcgcgtagctttaaattctccagtaccctgaggcgacgactctttaatcggtgctgttgatagttctgctgggcttttacggcagaataggcaccccgaccgccgttgcgtttaatttctcgtgacacagtggctttggaacaaccgatttgatcggcaataacctggtaagtatggtgtaaagttacacctaacagtatgcattcgcggtcttttaaggtaagatgtgtatatggactcatagcctaagaactcctttagatgattgttatggtgacttcattctacaggactcaggctaggagtctatttttattttcttacttgttgcacttcaattgtaaattcgtctatcaaaaagggcctagtacttttggaatggaaatactttccaacaccaaaaattctagaccctgtcggagtctaaaacatgataagatttagtcaattaggagaataaaaatcgtgaaaatcaaatttcttactaaaaaattttttagaccgagaccatctgaatttatctctattcaaactgataactttttgagaaaattaaagccgagaccgttttttacagaatatatcgagcaagttttcagaaagaacgttgaacctaacgttagccaaaattgcttgactttatcggttttaacggacactcatgaaaaagctgttgccagttcatcgtactatggtctcaacggtgtaaggcatattattgaagccaataaggcttgcgattcattgccagtggattacaatattcatttaggcgatttgatcgacggtagtgataagccagagatcagtcgaggattgttacaattcacgatggaaaattaccaaaatagccagcgtcctttttatgtgctggaaggtaatcacgatgaaaatgataagtatgatgaacacaaatttattacttcagcctcatttaaacgtgacgactactataatttggtaacgaaacatgatttcgaacaacctgagatcaaacgcttgagtcttggttccaaagttgcttggatcgataaaggggatattcgagtaattttcttgaatacgagcgatattccctatatcctaaatggcgggaccaagaagtacgacttcaaaaaagtccgtggtatccgcgagcaacagatcgaagatttaatatctattttagaaaagacaattgataagcatgtcgtagtttttggtcatgctaatttgatcagtcaaagtggtcgttcagctttgaacttcaacggtgacttagttcagaagatttttactagctttaataataaggattctggacaacttaaaaatgaattatccggggattttggagttaatgttcgctataactttactgataccggtatttcgaccatatcgaattatatttgtggacacatgcattatgaaaagtgctataaagttaatggggttaatcatataatattaaattgttcggccttaatgggtaaaaaacatggcctaacgactgattataataaaaaatgggatcgccgatataatgagatttccgaattagctggatatttcattaatatcaatcccgacaaaatgttgctccaaatatttggatatggtgcagcaaccagattcgtaagttttgaaatttaaggagaattaatatgtgcggtatcgtcggtttcgtagacaagaagattgctgacaaaaagccagttatagaagctatgatggatacgatcaaacatcgtggtccaaatagttcgggggaattagttaatgaggatacggcgctaggatttcgtcgattgagtatcattgatatcaacagtggtatgcaacctatttacaatgaagataaatcaaaagcagtaatttttaacggagaaatttataactaccaaggtattagagaagaattgatcaacaagggtcatacttttactaccgaaacagatacagaagtattgttacatggttttgaagagtggggaatggaagaattacttaagaaaattcggaagtttgtcaaatggtgttgaaggatagtttctatccttcaacacggttctgttgcaaagttagtgacctgattttgatactttttttcgcaaagcggtttgaaattttcaatgatgtataattggtatcaacaactaaattgattcattaattgggagatagtgactatggacaaaaggattgtgcggacgcaagctaaagctgaaaaagctttgtttgaattgatgcaagaacaaaacttttcagaaatttcaattacggatattgctaatcaagcaaaaatatcacgaatggctttttatcgcaactataacagtaaggaagatattttgaacaagtttattcaaaaagaatatgcaacttttgttgatgacattacgacgcatcattttaaagaattagagcagttgttggaagtttattttgactattttaaaaataatccagctgttttatcggcaattgttagcgcttcaattgaaggctttgctcttcgaaagcaaagtgactacttacttgatttttttaaaacgcgaattaaaaatcagcaaccagcaccaatagagattgcatattattcgggcgctatttttgctagtttactatattggcgagaaaacgattatcaatattccgcagccgagttggccgagcacctagcagaaaagatcaaaaatgatttactgcaaactggcgaaaaaatattttagccggttaatggaaaaacaaaacaatcaaaaaaggggtacggcaattttacttttgcagtgcccccttttactaggctaaattactttgttaggccatgccctagggtttgggtttcccgtaaataaactggatcggtcttagagatttgggaattctttgagcaacaacctagtcgatgacgacagcaactgtctttttggggtttaagatattttccaattacaaccccagtagctaaagcgattgaaattaaaattaaatgctgctttttcatgaatttttcctcctttgatttagagtaacttttgagatttcaaaatttcttcaagataggtgccatgaacctttttcaaaaaggcatttagaccaattttttcaatttgatttaaaggcaattcggtcaagctctttttatcattcaaataatataaggcacttaagattgttcgtaagtcaaaggcagaatcaaagacttctgggatgccacgatcaatgtcaagcagtcggtagacagcttccatagcagttctgacagagtattcagttgtaaagacggtgtctcgctcagtttcggcaaagttcccaataaaagccaaattgcttgaaccttcagggacaactaagggacgatcaccagcttggcgtggcataaagtatgaagtaatgtatggcatatgaattggaattgaattagctgtttgcgcgatctcagcaatttgattttctgggacaccaatatgataaagaaattcttgacagatttctgcgccactgcaatcagtaatttttttgtgaatataatttccgggctgatcggaaaagagaccatataaccatacgattaattcatttggcttttgttgttgaaaatgtggttgacggctgatggaaattcctaataaccagtttgagtccctaatggagactgggccactggtaacaattgaaccactatacggatctttaccagtaattttttgaatatagggtacgattcgatcgtctttaaaggtgcaagttgccgacatgacccagttagccgctggaatatcttgataaaatttagctggatgtccgaaagctgagtcttgagccgctaatttttcccataatttccagctagcaccgattggatgcgttgctggtgctgaatgttcattgtcaccataagtagtgctttcagtaattgatccatttgtaatgaaaaccaaatcgtcaggtgttaggtcgaggctttgctgattaccatcgatcgttagctcaattttaacagcttgtttttgttcaccggtttgttcaacaataatattgtcaacggtggtattgtattggaatttaacgtcgtgatcttcaagatatttaatcagtggtttgattaatgactcatattgattatatttggtaaatttcaatgctgacatattttgcaaggtgccaacatgatggacaaagcgtaataaataacggcgcatttccattgcacttgcccaaggctcgaaagcaaacatggtggaccaatagagccagaaatttgatttaaagaagtcatcgctgaaaacttgattaattttgacattgtcaagttggttttccggtgttagcactaatttggcgatttcttcaattgcttttcgggaaagcgtcaactgaccatcactggctaactgattaccacgtttttcgattacgcgggtgtgtgaattacttggatcggctttatttagccaatagaattcgtcaagtaccgaaacactggcatcttctaaggtaggaattgaacgaaaaagatcccaaagagtttcaaagtgaggttccatttcacgcccaccacgaataatatagccgcgttgttcatttaaaatcccatccatgctgccaccgggaagtccaagttcttcaaaaacatgaatttggtttccaggaacctgaccatcgcgcactaaaaaagcggcggcagctaaaccggctaaaccggccccaacaatataggctgatttcttggtggcgtttgctggttttttaggccgagcaaatgcttcataattaccactattgtagtacatgaaaatccctccttgtaaaataagataccaagtatttgttacatctgtaactaaatataatatacaacggttaacaaatttattcaatcaaaattattttctcaattaatatgaataaaaaaaactgcagcagattcgctacagtcctagaaaattagttaaatacgagctccagtttgagtattgaagtgatatgttttgcctttgattttttgaaagccataaagcatttgcccgttgttattgtagtaaacaattttatgctggttggcgatatattggaagccggttttcattaagaaggttacaatatcaaacaagtaccaatgcccattgagtggacttaggatgaaagtgtggacacgatttgatagaatttctactagagaggatcgtgtcttatgagtaaaagaaagagatattctgtcgaattcaagaaaatgatcgttcagctgtatgaaagcgggacatcagtcactgatcttaccagcgaatatgggattgccagtgccaccatttataaatggaatgatttgtacaagaaagataatgataccggggtctccaaggccgacttgttaaaaatgcaggcaagaattaccaagctggaaagtgaaaacaatatcctaaaaaaagcattaaccatattcgcaaaaaagtaagcatcaaagattggcagtcagctattaaagtaacggcatcagcgcatagcgttaaagaagtctgtcagacgttgcacttatgtcgatcaacctactatcagtaccagcaccagactaagcacgaacagtttaagcggcgccaagttttataccagcaaatccgacgcatctactttgatcatcggcgggtttatggcgctcctaaagttcacgaggaacttttacgtgagggctatcatgccagtttgaaactggttcaaaaactgatgcgacacctaggcctccggtcaattgtcgtcaaaaagtggcactatgagcacaacaactatattgaccaaatgacctaccctaatttgttaaaacaagactttaaagctgtcaaacctaatcaaaaatgggctgctgatattacctatattccgaccaaaactgatgggtggtgctatctgacaaccatcatggacttgtattctcgcaaaattatcgctcataaattaagccgacacatgacaaccgagttggttgtcaacgtacttaatcaagcttgtgaaactagaactgtcaaggctggtttgattctgcatactgatttgggcagccagtatcgaagtactgcccttgaaacagcattgaagcaacacgctatccggcactcttacagtaaacgtggctatccgtatgacaattctgtggtggagtcatttcatgccagcttcaagaaggaggaggtttaccaacggacttacaaagactatcatgaagccaatttggctcaatttagttacattgaaggattttataattctcggcgggtcattagtgccgatggctatttaactccagatgaaaaggaacaattagtcagttagaaattctacgtaatcgtgtctaaaaacttgactcagatccagttgtaaattataatttctgttggagtaaagtctttcaagtcaatcattgtttatccgaacctttttttgagccgttaataattaaattataaaataataacttaaaaaatacaaaattacaatttttttcattatctgtaaaatgtaaccgctttctttaaatgagtattatttaatggacaacattcccaattgacgttgctaactgttcattcacaagatcatttaatgacggctatcacctttatcgatttagcccaagaattaataaaagtttatcataaattagtggattctgatagtaaataagggggtatcaaacaatggaaaactcagatgcatttaaagaaaaaatgacgaatgcagttggaaaatttgctggttcacgttttgttcgagcaattatggaagcgggttatagtgttattgctttttcaattattggagcaatgtttttgattttagaagtcttaccgcaagcctttccgattccaggctttgctggtctttatgcagaaactttaggacgttttactaatttgttccaagtagtttataattcaacaatgggaattttagcactgatttttgctgggacattcacttatagttataccaaaatttatcaagaagaagaacatcttaacttgaatcctctgaatggattactgatgtttttaatggcaatgtttattaccgtgccacaattagtttggaaaggcggtacagttcagtttgttcaatctttaaataaagctaatatcattggcggtggttatgcggtttcagcctcaggggttacccgaattgcagctgttggtatttttactgggttagttgttggttggttaacggttcaaatttaccgttttacaattaaacataattggtcaatcaagatgccggcttcagttccagctggagtagccaattcatttagtgctctgattccaggattttgtgtagcatttgtaattgcattactcaaccttattttagtatttgcgggaacagatattttcaaggtcttgtatattccgttttcatttgttagcaatattgccgacacatggtggggcttcttaattattattttcttgattcattttctctggtggtttggaattcacggtgcaactattgttagttccttctatacgccgattgttttagccaacatggctgcaaacgttaaaggagccaatcatttctttgctggtgatccaatgaatgcttttgttatcattggtggttctggggctaccttgggaatggcaatctggctgttttcaagagcaaaatctgcccaactaagagaaatcggtaaagcagaaattgtcccggcgatctttaacatcaatgaaccgattatttttggcttgccaattgtttacaatgtccagttgtttattccgtttgtgtgtgctccacttgcatcaggaatagtggcgtatcttgcagtaacttctaagctagttcataaaattattgttcagcaaccatggccaacgccagttggattaggtggttttattgcgacagctagctgggaaggttcagttttagcgattatctgtgcggcagtggcctttgccgtgtggtatccatttatcagacactatgatcgtactttactgaaaaaagaacaagcgatggcaaccgaagaaattaaataaagtacttgtcttcactagatcggagcagttgaagtgtgattgagttaaaaactggttaatgaagacaatgggaaagttagttcaggtattcaaaaagaatatttggactaactttttttgtttattgactgacatttttattaagtgttatattatagactttataatattagtaaaaaataaaataaaacagcatcaggctgaattagcacaaacagatgccgaatacaagcgatcacgatgtggtcggaaaactaagctgagcgatgagttaaagcaaaaaattctcaaccatttacgtctaagctggtcaccaggaagatttaacgacgacgttactccaaattaaccagcgaccgcttaaaatactcgactggcaaacaccgtatcaggttatgctgacaaatttgtccaaaaattcggattaaatttgcaatctaccttgaaagcgcttaacaacacaatgtttagatgtattctgaatttgagtatgtgacgttgtttgctggtcggcaggcaacgcttacttattaaggatgcgaaactgtagcgaccccaattaatcacggtcgttattaagtgtctcactgatagtgaacagctattcgtgaggcaactaaactctgagaggagtgacaagcatgacagcgaaacaggaaacacgaaaaaaagacgcccaggaagacgttgaaacactctttagtgcactcaagacgaccaaaaccgggctgacgcaacaggaagcaaaagcacggttggacaagaatggtgccaacaccatcacccatggccagcaacagtcgcaactcaaggcatttttgagcaacttcattagcctgatggcgattttgctctgggtcagcggcctgattgccatgttgtccgggacggttgaactgggcattgccatttggctagttaacatcattaacggctgctttagtttttggcaggaacaccaagcgcagaaggcgaccaattcgctaatggcgatgttgccgacctacacccaagtataccgggatggcaaggtcgtccaagtcaatgcgactgacctggttgtcggtgatgtgttcgagctgcaggccggtaacgcggtgcctgttgatgcccgattactgtcggcaacatcgatgcaggttgaccagtccgcgttgactggtgagtcggtgccggagtcgaaaacagcaacttataaccctggcgaaggcgagtttgccgagagtaacttgatctacgcggggacgacggttggcgccggtactgggactgccgtgacactggcgactgggatgcagacggagtttggccagattgctgcactgacgcagcaacaggccaaacattcgagcccgttggaacaagagcttaaccgcctgacgaaacagatatcgatcattgcaatcggcatcggggtcgcgttttttatcgccgccattttcttcgtgcgttatccagtggcgaaatcgtttatcttcgcactggggatgatcgtggcgttcattccggaaggcctgctgccaaccgtgacactgtcgctggcacagggtgttcagcggatggcgaagaaacacgcgctggtcaaggaattggacagtgttgaaacactgggcgaaacgacggtcatttgctcggataagaccgggacgctgacgcagaatcaaatgacggtcaaccacgtgtggctgcggcatcaggtttatacggtatctgggcacggctatgtgaataatgggcatgtgttgttaaatgaccagactgtcaactatgaagacgaccccgatttgaaacgattgatgctcgtcgcaggcctcaataatgatacgaaagtgcagacggaccccgacacccaccagccaaagttacttgggacgccaaccgaggcggccttagtcatcatggcagaaaaggcgggctttgacgttgagaccgttgccgcgaaaacaccgcgcctcaaggaactgccgtttgactcagtccggaaacggatgagtacaattcaccagcacgatgccaacacgctgtcgatttgtgtgaaggggtcgctaagcgatatgctgccgcagtgtacgaccattcaggtggacggcgaaacgcggccaatcacccaggcggatctggatgccatcaataaagcgaacgaaacatacgctgctcaaggcttgcgttccctggctattgcctaccgtgagattcccgctgaagcagatgttaacaagcaggtggccggtttgacgatcgataacgccgaaacggacctgagctttgtcggcctgaccgtcatggccgacccgccacggcctgaaatctacgatgccgttcaaaagtgtcacgatgcgcagatcaaaatcattatggtcactggggacagcgcattaactgctaaatcgattgctgttaagatcggcctgaccagcgataaggcccgggtcgtgaccggcacagaactggaagccatgggtgaggatgagctgaaaacggctttggccggtgaaatcatctttgcacgagtggcgccggaacagaagtataaaatcgtttcaacctgtcaaaagatgggggagatcgtggcctcaactggtgacggtgttaacgatgcgccagctttgaaaaaggcggacattggtgttgccatgggtgttaccgggacggatgtcgctaaggacgctgctgatatgattttgacggatgacaactttgcctccatcgtggctgcaatcgaagagggacggacagtgtacagcaacttgcagaagttcctgctctacatcttcaactccaacgtgccggaagctattccatcggtcctgttcctattcagccgcgggttgattccactgccgctgactgtcatgcagattctgacggttgaccttgggactgacatgttgccagcgcttggactaggtgctgaaaaggcagaaccgggtattatgcagcaaccgccacgtccgcgaaacgcgcacttattgaataaacgggtcgtctggacggcgtttgcctggtatgggctgattgcctcgatcgtttcgaccttggcgtactttttcgtcaacatggaagcgggctggccgaatcagccactggctgccagcggcggtttgtacgcccgagccacaacgatgacccttgccgccatcgtcttctgccagattgcagctgcactaaactgccggacacaggtcacttcagtgttcaaatttggactgttcagtaaccaccgggtctgggctgggatcgtttttgaagtcattctgttagcctttctagtctacacgccaggtgttcaaagcttgttcaacaccgcaccgttacaattgcgggattgggggttcctgtgtatgatcccgattccgatattcttgattgaagagctgcggaaatttggggtgcgtcgggtcaaagctatcaggtagagagtatggcatgcatttccactcagttgtttagagggtttcattgcaatcaaatatcagcctaaatgaaagaatggggacagaagggagtttgccccagaaaaaaataagcgtcccagccaacaatccgtttggaattgttagctgggacgcttatgtggtcagatgtgaccgctggctgcgcgtttatgccggattactaggacgcgctagagtgacaatgctattgataccgtgattgcaaactagttttttaacacagtggaaatgggttttccgctcggtcctgtaatgattaccggcgcgctttaatgccttttatggcgtaaaaatcgcatataatgataggctccctgtggcgcagggcgctaatcaagttttgtaattgattcacgcgtatgatgttccggtaaatgcttctctggaaagggtacgacgatcaccacaccgatcgtcgtggtaccattggccgcgcagttgaaacaagttggcacaccaacggtaaccgtagatggtaaggcggtgaccgcgcaagtggtgccaatgagtggctattttaacattgcctgg

SEQ ID NO: 738 - DNA, 48617 bp, Unknown
  Metagenome-assembled genome
gaaaacaattgttagttggcttacttgttgggcaaataaaaaaagggggtctcccctagcgctccgtctgcgacgtccttgacctcgacgcaggcagcctcatccttgcggacggaaagctcgtagccacgcacggtgagctcgatcgggtcgccgagaggtgcacctcttcacatagacatcggtgcccctggtgaggcccatgtccatgatgcggcgcttgattgcgcccgtgcccgtgagcttcgcgaccgttgcgctctgccctaccttcacgtctctcagagttggcattatgctccttccatcaagctcagaaaagtcctgctgcccttaatacacagagattggatgtcacgttccgttgaggccgaacgtcgcacccttgacagagacgatgcagtcgctttcacgcggctcacgaccttgacttcagctccctcgatgaagcccatctcgcaagatgctgcctgagctctcgaccacggaccttggaaaccacggccgtctgtccgctcacaccatggacagcggcaggtttgccgcggagacatgggatgccatgttctggcctgcacctatccgtgccatatctacctccatgcgtgcctcttggtgcagcaggatgaggctggtcctgcggtccccaaagttatacggcgttgatttacgcaaagagataccgctgcaaactctctggaagggatagattgtgagattggtcgaacttttttgctccaataagccacatatcctgccagatgggcactccatgaagccaaatatggccgtctgcctgccagaatatgccgcaggcagaaaactctttccttttggccacctctccagaacgacacccacacgttgcaggtgcgccctggaggacgcacacatagacatccggaacatttctggcatatgcctcaggtccagcgaagatgcaggacagcttcccggcaagaaggtggacacgcggaggtgcggctcgctggcgacgaatcttgcgttctccgatggatcgagctgccaggctgaaatgattccaaactcagcttaggcagcagctccggcggaagcatcaatggctgcccagagtagaggacatcttttccaaaggagctcagacgcctgccttatcagcccccagcccttgcagaaaaggaggacagccatgaggccacagataagccctttgacagacgcgatgctctatccctggcagtcatgctccatctcgaagctgcctcaattgtcttctggttcttctttgccgccaggcagacatcacgtacaacgcctttcccgatgccctgatcgctcctcatcgagcctggagctgggggtcggcgcattcttcctcaaagcatctcatgcacgcatcgcagccaaagcatccaacgctccatgcgccaaggcgtctgcctgctcctggttgccgtccatatcgtctgcctcggtgcggtcatagcgttcgggacagcgatggcatacgagctgctcgtgccttcatgggtatatgcaggtgttcctgcgctttgctcccgtcttcatagagcgatcctggcatcaggatgctgagggatagcacatgctggcagccatgctctcgtgcatcctggactcgtcttctttcgtgctggcaggcatggcgcataaggaaacgctcccctcccggaggaagaggagcgccgatgaagtatatgtctgggaaaacctcacccggtgtttggaggcctgcggcaactccggagacagtgcagaggataaggaagatgaagcgctccttctcctcggtgtgagcttctcggactcgtcctcgcgcctcaggcggtcaagcgccttcatctgcatgatcgaaagcgcattcacgaacggcagacgtgcacggacaaccgggccgaggacgcggcggtgctggagggctcatcctcgttgaggatggcaaagaccacttcttcgtgagcgcagctcgtccatgaccatctcggagagctgggcctgttgccgaggcccatgtacatccaggcatgcgtctgtcggtcttgcaagagacatctcgatgttgtcgatgaaggtctggaagagcggccactccgcataggcatggcgggagcatcaaggtccccgaaggcctcgcaggcgcttcccaggccgtaccaggcagcgaggttgatgcgtgcctggctccagctgaagatccaggggatcgtgcgcaggtcgtccaaggactttgcgccgaggccacgcttggcaggacgtgagcgataggcagaagaccaatctcggcaagcggcgtgacacagctgaaccactcggcaaagccatcctggttcaggagcttgaggtaggtctcgcgcgattccttctcgagctctgcggccatatcgtggtacttctcggtgtagatcgtattgatcttgccgatctcaggcgaggagtgcatgagcgttgctgctgcgacagactcgacatggcggcgggcaagcaccggattgcgtaggggcaaagatgacctcgccctgctccgtgagcttgaagcagcagttgacagagcctctcgggcgcgagcacgcgtggtttgccgggccgccgccacggccgacagcaccgccacggccatgcatgaggacaaggtcgatgttggtggcctggcccagtcggcaatctcttctgtgccttgtggagcacgagggtagccggtgggccgcatccttcgaggagtcggagtagccgagcatgacctcgagacggcggttcgtctgggcaaggcgcttcttcacgtcggggagctcgatgatctgggagagcgtcgtgacggcgttctcgaggtcctcgactgctgaagagcggaatcacatcgagcgtcgggacgtcctttcatgggcgaaggagaggggtgccagctcatagacatctgccacgttctgggcgctcttcgtgaacgagagatgtagcgggtgcagcctcgacgccgttcttgcgccggatggcaccgatagcgcggaacgtgtccacgacttcgcgcgtcatcggctgcagctggcctgtgcggccatgctccttgaggtcggcaagggcgcgggagtgcacgaccgagtgctggcggaactccatctgcaccatgttgaagccgaaggtctcggtctgccagatgagcgtctggagaagccatatgctcacggacagcgcctgcctcgacaagcgagtcctgcacgacgcgcaggtctcccaggaactcatcgcatctgcatacatgaggtctgccgtgcgggcaatcgttgcacgcaggcgctctgccatgacagcatgacagcacggggagctccgagacagagatcagcatcaccggttgcagagctcttcgttcatctcgagctggtggtccagagattctgaagggcagcagacggcttcgtcgagccgccttccatcgtgagcgcgagcgccgacatattccgtgctcggcaagcttcgtgagcatatgcacacggaacttctctgcgaccttgcgcgagacctttgcgtgacatgggttgccatcgcggtcagacccgatccaggagcccagacggaagaaggctgggcagaccggcttcacggtgccggccttgcttccaagctcccagtcatcgaagcggcggtagaccttcgggatcatctcgaagagcgtcgaatcgaagatatcgatgatggtgtcagcctcttcgaccggcgtcggcttcttcgcagcgatgggagacgtggggaagagcgagtcaatctctgagcatgcggcgcgttctccgcaagctccgtgccgcccagagatggcctctctgcagaaggtctgcatgcggcggatctttgcggtcaccccttgcggcgtgcctcggtcgggtggccgtgaagaccgggtggaatcgagcggttcaggaaggagtctgccttgtccttgccgacctcttcgatcaggcggtggtaggaaaccgtgatctcgttcacggggtcttcggcagagtccgtcggcacgacacgctcgcggcgcggggcgagctcaccggtagtttcctcagcgatattcgcgagatggaaatacgtcgcgaaggcacggtcagatactgctcctcctcgagcgtcagttgtcgatgaggcgacagccgcgtataggcttcgtcctgtctgtctcgagatgtcttcgtcatttgcatggaccatgtactcgagcagaagatcgaagctgctgcagagcttgggatcgtctccttgaggacacgctcgctcagaagcaggacagctccatgttgtggcggagctcctggggaatgcggacctcggacagggcggaagcggcagcagcacgctcattcgaagcgttcctctgtgcctgcgttcccaatgggaatcaaattgggatgtactacctccacatagagattcacgccgttcacggaaaattctatcaccagaacattccagaattatttcgtgcgcaccccacagactcctgacaaggccgacacatgcacagaaaagccagccaggacaggtgtcccagccggctttgcgtaacatcttctgtcttgctcctacatgaggcgcagggagacttccttgagctgtgccatggagactcggacggagcatcgctcatgaggtcggagccggagctcgtcttcgggaatgccatgacttccctgatggagtcagagccgtgagcagcatgcagacacggtcgaggccgagtggcgaagccgcccataggaggcgcaccataggtgagtgcctccatcaggaagccgaactgggccttcgcgcgctcaggcgtgaagccgagcttctcaaggatcttctcctggagctgtgcgttgtggatagcatgccaccgccgccagcctcgtagccatcatgacgaagtcataggtgtgcgagccgatgcaagaggatcggtgtcgagcaggtcgattggtcctcattcggctgcgtgaacggctggtgctcggagtcgaggcactcctgtcctcgtcccagtggaagagcgggaagttcacgacccagaggaagtatggccttcgcgcttgatatcgagggcatcagccatgtggttgcgcatgccgcccaggattcgtcgcatgggacggttgccacagcgaacatcacgaggtcgccgctcgacgtcatctccttgcggagtgctgccactcctcgtcggagaagaacttcacgatcgggctcgtgacggagccatcctcgcgaaaggcgatgtaggcaggcccttggcgccgaacgtcgcggccacatcggcgaggcggtcgatcttggcgcggggccacttgccggcacccttggcgttgatggccttgacatactggcttcggtctgggcgccgaggcgaagagcttgaacttcgactggccgaagatcggcgtcacgtcgtgcagcgtcatgccgaagcgggtatccggcttgtcgatgccgtaggtatccatggcatcccagtactcgatgcggcgccgcggcagctgcatctcgacgcccatggcgccgaaggcatccttcagtacctcttcgagctcgcccatgacatcgtcctgggtgacgaagctcatctcgacgtcgacctgggtgaactcaggctggcggtctgcacgaaggtcctcgtcgcggaagcacttggcgacctggcagtagcgctcgacgccgccgaccatgaggagctgttcaggagctgggagactgcggcagggcatagaagtggccggctgcgtgcggctcggcacgaggaagtcgcgggcgccttccggcgtggacttgaagagggccggcgtctcgacctccatgaactcatgcttgtgcagtgcctcgcggatcgcgaacgtgaagtcggagcgcagcttcaggttgtgcatcatcttcggacgggcaggtcgaggtagcggtagcgcaggcgcacatcctcggctgtatccacgtggtcctcgatctggaacggggtcgtcttcgaagtgttcaggacctcgtcgtggagacgagcacctcgatctcgcccgttgcgagcttctcgtttgccatgccctcaggacgctcgcgcacggtgcccgtgacaaggatcggccactcggtcggatggttcggccgtatggaggccgtgccgcggagtgctcagggtcgaacgaaacctgcgtcatgccctcgcggtcgcgcaggtcgacgaatgagagcccgcatggtcccttctgtgccacacccatcctaagcgtgacttcctggccgatgtctgatttggcagctccccgcaggtgcgggtatgcatgctgtgctggtccatatgagatatcctctcatctgtgccgtcccgtgccgtaacggacggctcccgacagatggcgcggggtgcgtagacagcgtccccgcacacgcgtcggccattgtactccagaaggcagggcgggcagcaagcctcacggaacgttaccagcctgccacgaaactccagagagcgcatggctgcccgatgctcctccggcgctcccctctcatgcataagctgggagattcattcaggaagctgtccaccagagcgctcatgcgtccagacactaccgtctgcctgcctttttgcgcatgagtggggaaaagctagcctaggtgcgtagattttcttgtggataaggactgagaccatacgaggccacggtccagggaggcagtccatgcatacgcagcagcgatattcgatctcgatgggacgctcctcgatacgctcgacgacctctgtgacgcggtgaactatgcgttggcctctatgagctgcgctcaagagcacgacgaggtccgctgggccatcggcaatggcatccgcaatctcgtgcgcaccgccttccgaaggatgcagatgaaggcacttcgaggaggtcttcgtcgccttcaagagctactactgcgagcactcgatggacaagacccgccccacccccgcatagccgctgtcctcaggcatctccgcacgcgcggccgctgcgccgtcgtctcgaacaaggtgatgccgccgtccagacactcatcgaccacttcttccccggcgagttcgatgcaatcgtcggcgagcgcgaggcagaaggcatccgcaagaagccggcgccgatacgtgaacgaggtcatgcgtgtcctcggcagtgagaagaaggatgtcgtctacatcggcgactccgaggtcgatatcgagaccgccgcaaacgcccagtggactgcatcgccgtgacctggggcttccgcgtcgcgaattctcgaggacaagggggcgccgttcttgccgagacgccggagcagctcgagcactcatcaccggcgaagggctcgacggcacggccgctgcctgatctggcgcatccattcagattctcttgcatttcgcgtagcgcctttggcgattatcaaagcgccgtaaaacccctgtctttaggcatggggatataaggcgcatcgccgcagacgatattagatagggatcaatggataaatccttccatgactacagagcaacaacaacgtcgtctacagctgcaggtaccacgtggtcttctgcccgaagtaccgccgccccgtgctcgtggacggcgtggacgagcgcttcaggcagatagcgcggcaggtcgcggacgagctctccttcgagatctagagatggaggtcatgccggaccacgtccacatgctccttgaggtggacccgcagctcggcatccacagggccgtgaagcgcctcaaggcaggaccagccacgacctgagggaggagttcccctggctcaggaagaggctgccctcgtctggacgaacagctactgtctccaccgggcggcgccccgcttgcggccgtcaggcggtacatcgaggccagaagaacgtgtgacccatcatggacagacgtttgaatacaggatctacccgagcgctgcccaacgcgtgcagcttgcaggaccttcggatgctgccggtgggtctacaaccgagtgctccaatgcggaaagaggaatacgagcgggacaagaagacccgatccatcaatccatatcacgcagatacccatctggaagaaggacgaggccccttggcttgccgaagcggactccatggccctgcagcaatccctgcgcgatctcgacaaggcggacaagaacttttcgaaagccctggaagggtagggttcccccggttcaagtcgaaatcaggtgcaagacagagctaccgcaccacaacgcatctcgatcgtggacgcccgccatgtgaagcttccgaaactggggagcgtcagggcgagaatcacccggcccgtccgggggggatcctctccgcaaccgtcaagaaggtaccctccggcgaatatttcgtggccgtctgtgcacggactgcccagaaccggatatgccgcagggtgacgtcgaggtcatgggcaagacgccggcatgctgcctgatggcccgctcggacggcgaggtggttgccagccccaagagcctcaccaagtcagagaaagagattggcccgcgagcagaggaggctctccaggaagaagaagggttcgaagaggcgggccaggcagcgggtccgggtggcccgcatccatgaaagattgcgaaccagaggaaggacgccatccccaaggccagacggaagcggtgcgccgagagccaagcatgccgtcgaggacctgaacgtggctggatggagaagaaccgccgccttgccagggccgtggcggacgcaagcatgtcagagatgatccgccagctccagtacaagtgcgcctggtagggcgtgccttcgtgaaggtgggaggttctaccgtccagcaagacgtgcgtgctcgtgctgcggctacgtgaacaagaacgtcgtgcttggggtcgagagctggacatgccccgagtgcggggcccgccacgaccgagacctcaacgcggcgaagaacatcgccgccgagggcgcgaggctgctggcggagggaaacggtaccgcagggcttgcgggaaccgggggcgcgcaagcgccccgaacgctcgtggagcaggcgtaagaccgcccgcgccatgggggggaaggctattgctgtgaagcgagaatcctctggcttagccatggggagtgtcaatcggtgagggcgctatttccgtcactggcccaagcggatgttgagtttgttcaaggacggtatagtgagtgcaagcacgttgggtctggcccttcgacgaaaggacatgccatgggaagagagcatccgaggactcgatatcaatcgatcagctggctgactacctccacagccatcactccgtctacatgaagatcgatagcaaggtctactacctgaccgacgtgaactacgaagcatgggcgcacaggacaccagccagcgcaacgaaaagggccactacatcgactgctccgatctcgttgacatgtggacgagttcctggcacttccgttcgtcggcggaaagacgatcaaggacgtcttcgacggcgccacgttctatgcctccatcaagggagacaaggagtagacactccagacccaagacatgcagcagggcccgccagatggcaggccctgctttttcatgccatcgtctcatgagaaagggcgccttcctccggagggcgcccttcgaagcatcaggtgctaatcggccttcggggccgtcggcagatcttccggatgcacgccgtcatctgcgtactcgaggtcgtggatgaggccacggaactcgttgtcgaccgcgttcttgtgcggcgagcgggccgcatagcggggcacggctgctgccgacttgttgatcgcgacgagggtaccggcgcctgcgacgcagccgcccgggcatgccatgccctcgagcaggtatccctgatacttgcccttgacggcgtccttcatcatcttcctgcattcctcgaggccgccagcctgggccgtcttgacctcggcatcaggacggtcacgcttgatcacgttcacgacagcattcgcgacgccgcctgcgacagcgaagttcctgccatccgtggatgcgacatcgaagtcggacttgttgtcatcggcaagtgcgaggtagtcgatgccacgtgcttccatcatgccggccatctcctcgaacgtgaggacgaagtcgacctcggagcgcacggagcggcgcatggcctcgagcttctttgcggagcacggtcccacgaagacgatccttgccttcggatgctgggagcgcaccatgcgtgccgtcaatgtcatcggcgtcagtgccatcgagatgcagtcggcatacttcgggaactccttctttgccatcgagctccaggccgggcagcacgacgtgcccatgaacggcagcttgtcaggcacctcctcgaggaagtcctctgcctcctggacggagcacaggtcggcaccgagtgcgacctcctcgacgccggagaagccgaggagcttgaatgcctcacggagcttgccgacattgcccttgccgccgaactggccgacgaaggcaggggcgacgattgcgatgacctcctggcctgccaggatggccatggcgacctggacgatctgggacttgtctgcgatagcgccgaacgggcagttgatgaggcactggccgcaggcaacgcacttgtcctggtcgatctctgcgtgcccctgtgcatcggagccgatggcatgcatgccgcaggcgtcagcgcacgggcgcacgtagtgatagatggcatgatacgggcaggtgcgggcgcacatgccgcagtggatgcagaggtcctggtcgatgaaggccttcttgtccttgaaggagatggccttcttcgggcagatctcgcggcaggggtgcgcaaggcagccctggcacatgttcgtgacctcgtagatgttgtccttgcaggcattgcaggcgaacttgatcacgttgatcagaggcggctcgtagtagtgctcaggacctgcggcgtcagcaaggccctccgagatatgcgccggcctgtcgacgccctggagcgaaaggcctgcagccagacggatgcgctccgagacgatggcgcgctcgaggaacacggactcgcggtaggtggccacgtctcccggaatgatcttgtacggcagctcctcgaatgccttgtcgaagtcggcaagcgtccagttcggattcctgccgttgtcgtagatgacttttgctacttcgcggaatacggaccggcggattgccgtcaggttcgtatagacgccacgcatggtgtcagccatgaatgcccctctccgagcatcggaacggatttacgttgcttccctgtttccaagtctaccgaactcaggaaggcaaagcgtgctcaaggatgcgaaaacctgcactttccagcttggtgtctcatcgtttccgcgactcccatgctgcgagtgcacgctctatttcgttgcctccgaagagcgaacagaagctctcaggcacaggggccgtggcagagagcttctcccctgtcacaggatggacaaacgactcccgccagcagtggagctgaaggccgaagcgctcacgcccgcccttcggcagaaggtcaaagccaggtaccgcgggcccgcctctcatcccgtagagcgcatcccccagaatcgggtgtccctcagaggccagatgcacgcggatctggtgcttcctgccggtgccgagcgagacgagggcaagcgtgaggccgcccttccgaaggagctcccagaccgtggtcttcgcatccttgccggaaggagagacgcgcatgcgtcttgcatcgtggcggtcgcgcccgagaggcgctgcaatcacatgcggcccttcaggcaaagatccccgtacgcaggccagatagagcttctccattgcatgccctgcgacaagcgtgtccaggcctccctgaaactccggggcaagcgagaagaggacgcaccctgtcgtatcctcatcgagccgctgcacagcctgggcagaggcgctcctgccttcttcctcaagatgcttcctgacacgcgctgtgagcgtatccgtcttgccgcctgtcccatccgaatgcacgaggatgccagaaggcttgtcggcgcagagcaggaacgcatcctcgaagaggatatcggcagcacgcgctgctgcagccggcgcatcgggaccttctgctgcgtccttcctgaggacaagctcgaccagatctcctgcatccagagcatctgctggcctgagcggcccggcatctctcgagaggcgcctctcctcaaagatctccttcctctgcgtcttcgagacgccggcagcctcgaggagcgcatctgctgtcacgtccgcatccacaacgaatgagacccttgcgtcatcagcctcggcgatatggtacggacgcatatccttatccctcatggtgcatctctcccacttcttcggcgagcgtcctgtagaaggcttcggtcgcgctccagatatgatctgcgttcctccaggcaacgttgatccagtagagcgccttgtctccgagatggatgagccggacctgcgtctgctcctcctctgaaagagaggagaagacgagcctcctcgggcagaagaaggcacctgcccccttcgcacagaggtcgagcagggtctctgtattggacgaggtgacctggatcgtcggcgtgatgcccgactcgcggaaggcctggcgtgccagatctcccggaatgtcgcgcttgcccaagagcaggaatgggcagtcggcgagaggctcgagcgtgcccttgcgctccacttcggccacgacttcatccatatgtcccccgaagagccttgagagcagctccttcgcgacgacgagcacgacctcctccttgtacaggtcatgtaccgcgaggccggggatgtccttcggcacggtcgcgacgatgaggtcgagctggcctgcctgaaggctctcgatgagctcctcgttctcctcctcgacgagatccacctcgatgccggggcgcctgcgctggtaggcagcgatcgagcggggcatgatgaaatgggagcgggtcgaggcgatgccgacacggagaaggccacgctcatctcctgcgatgtcctggaactcctgctgcatcgagcgctcgaggtcctgcatcctgcgggcagagcccaagaagacctcgcctgcataggtgagctcgagcggcaccttgcggatgatgagacggacgccgagctcatgctcgacgcctgcgatatgggccgagagcgtctgctgggtgatgccgaggcgcgaggaggccttcgtgaagctgcgctcctctgcaagcgcaatgaagtagctcatggtagagaagttcacagagtctccttgcctctatgcagacagcacctccttccatgcgtcctgtttccgacagcagagagacggactgtctgtgacctgcggaaacgtgcccgaaacaaaggaactgtcgagttacaagatttctttgtattcataacctaatataacagttggactcattgtttcaagggtcctatcctgcttttcgcgctcaggaaagaaatgctctcaggaaggtccgccatgacagaatccatcgtactcgccgtctttgccgcgatgcttgtcgcaggcattgcagctggcgtgcccatcgtctggatcctcgtagcgggctttgccctcttctccgcctatgcgctgaagcagggccacagcgtgcgcgaggtagcgcacatggcaggaagtggcatgaagtctgtccgcgatgtcctcatcctctacctcatcgtcggcatgatgtgcgcggcatggagggcttcgggcacggttccctataccgtgagcgtctgcgcaagcctcatgacccctggcatcttcatcctcatgaccttccttgcctgctgcctcatgtccaccctcatgggcacctcgaccggtaccgctgcgacgatgggcgtcatctgcatgacgatcgcatcggcaatgggtgcagacaaagtcctcacaggcggcgcaatccttgccggctccttcttcggcgaccgcatgagcccgatgagcggctctgccctcctcgttgccggcctcacgaagaccgaagtcacgaagaacgtgctcaggatggcaaagacagctgccgtgcccttcgcgctcacctgtctcatctatgcagccttcggcttcacgacgcagcacgcctcctcgatgccgcagatggcatccatcttctcccgctcgttccacatgggctgggtccttgccattcctgcccttgcaatcgtcgtcctctcgctcacgcgcgttcccgtcaagaagacgatgcttgcatcgctcgtgcttgcctgcatcgtctgcgtcgctgtccagggcgtggcacctcaggatcttccaggcctcctcatcttcggctatacgtcgacggaccgcacgatcgcctcgatgcttgatggcggaggggtgctgtcaatgatgaacgtcgcttcgatcatccttgtgagctcgacctactcgggcatcttcgatgggacggggcttctgcgtggcgtctgctcgaaggtctgggagctctcgaagcgctcgacgcccttcctcggcgtcctcgtaacgagcttcatcgcgaactgcatggcctgcaaccagacgctctcgatcatgctgaccgaccagatctgccgcccgaccgagggcaccggcaccgcacttgccctcgacctcgagaacagcgcggtcgtccttgccggcatcatcccctggagcctctcctgcgtggctgtgctctccttcatcggtgccccttcgacctcggtcgtctttgcctgcttcctctacctcctgccgctctggacgctcctcatctcctatgcggtgcaccacgacaagagcttcgtgaagaagacgccaggccagctccttggcctcacgacggacgacgtcgcacagcctgcacagcttccgcttgctgcctagcatgtcctaaccagagcatctattgcctgcagcctctccggcacgtccggggaggctgcattgctttcactcccctgccctgcagaggggaactccatctcggctcccatcctctcctggaacaggagagctggcaggagcaggcctgctctccccctctccgagacaagcaggagcagacaggatgaagcaggctcttcaagggccagggcatcgcctctgcctccagaaatcctttccaggcacgaagcagcctctgctgcctattgcctcagccgatcctccttctatgcacatgaaggcgccctccggttgcaatcagtccggagggcgccttcaaagcttgtacggctcttcctgggggaaaggaggaagccaggaagaggggctatgcgcgggtggagcggacgatctcggccgcttccttcgtgagggcgagcatctcgtcgaagcggtgctcgcggatcatctggggcttgaccatccaggtgccgccgcaggcgatgatggcaggatctgcgagataggctgcgaggttctgggcgttcacgcctcctgtcggcatgaacctatggcccacaaagacggaggcaagcgccttgatcgtggcaaggccgccatactgggcagccgggaagaacttcgtgacctcgaggcccttgttcacaagagcggtgacctcggtcggggtgacgcctgccgggatggtcggaaccttgttgtcgaggcaccactcgacgacgtccatgttgtagcccggcgagacgatgaacttggcacctgcatcgacagcgcgctttgcctgctcgaccgtgaggacggtgccggcaccggccatgatgtcagggcactcgtctgccatgatcttgatcgactcggcggcggcgtccgtgcggaacgtcacctcggcagaaggaaggccgccctcgacgaggacctcagcaagcggctttgcgtcctctgccttgtccagcacgacgacaggcacgacacccatcttctcgacattctcgtagaaagaatccatgtaagacatatccgtctcctcacttgttttctagcggctgaccctgaggcctgcaccctttgcagctaccgctgcgatatcctctgccgtggcgaagttcgaatcgcccttgaccgtgagcttcaggacggatgcggcaatcgcgtaggatgcagctgcatcgtagtccatcctgtgaagcagggcgtggatgaggcctgctgcgaaggcatcgcctccagcgaccccctcgagcacatgcatgtgatgcaccgaagagaagtgcgccttcccgtctgcatagatcatgcccatccagtcggagtcctcgacggagcggatgtcgcggatgacggaagcgaccatcttgacgccgtaggtgcggacaagctcgtctgcaatctggacgtaggcatccttctcctcgatgcccgtggcaagggagcccgagccataggagatgccaaggcaggaaggggcatcctcgtcgtttgcgatgcagatatcgacgagcggaagggcacgcttccagaacttctttgcctcgtccggcgtccagagcttgcggtagttgaggtcggcgacggtcacgatgccgtgcttccttgcagccgccaatgcctcataggcagcctctgccatctccgggcacacagccggcgtgacgccgctcacatagaagacgctgacgccgtcgaggatctcgtcccagtcgaagtccgtgtgggatccgagattcatcgcggagtacttgcggtcatagacgcagccattcgagcgctcggaagcgccgatctcgaagaagtagctgccgagacggtcgcccttgcgcacgacgcggctcacgtcgacgccgtaggcagaaaggctcctcaatgcgcagtcgccgatgcggctttccggcacgatggagacgaatgctgcatcatccttctgatatgccagagagaacgcgacgttcgcctctgccccgccgtaccgcacatcgaacgaatttgcctgctcaaggcgcagatgatcgggaggcgacagcctcatcatgatctctccgaaggtcagaaccttgccctcaagcttcatgatccatcctttccggcacagatccgcctgcccctctgggctcctgcggttctgtctctctcaacgattccaaatctagcatgttagttatccgttgtatagaggaaatcttgccagatggaggaaatctatgcgaacggatattcaggagctgcctcagctgcagtccacgtctttcctgctgacgcacaagtaattgcccgaatgccgccgtttggccgacagatgcagctctctctatttcttggatgctagtttgcgtggtatgctagccgagaaaggtacgagaggagattccatccatggcagggacgacagagcaggtcgaagagcaccaggaagcagccgagcttcccgacaagcagcaggacgaggcatatgagcgcctgaagcgcggcatcatcgagttcgagtatcttcccgggcagcgcctctctgccaaggatgtgcgcgagaccttcggcgtcggcaggacgccggtacgcgaggctatcgtgcgcctgcagcaggaaggccttgtctatacgaaggccaagagcggcagctatgtctctctcatcgatatggatgcggccaagagcgcccattttctgcgcctcaacatcgagcgtcccgtcgtgcgcgaggcagcagcacgctgcacggaagagagcctctcgggcatgcgcgccacgatcgaagcgcagaaggcagccgtcaggagccatgaccagagggcgttcttcgatgcagacaacgagatgcacgaggcgatctatacgattgccggcaggatctacgagtgggcctggcttgcacgcggcgctgtcgacctcgaccgcttccgctggctccatgtgaaggcacgcggcctcggctggcagtccatcctggacgagcacgagcagctccttggcgccctcgtgcaccacgatcccgaagaggcagcctacctcgtcgaacaccatctccatgtgatgctcgacgaaaaggaagaggtcctctctgccttccccgactacttcaagaacgccgaggaccagacggcctagaggacgccttccagcacaaggaaagccaccacaagcaggatggcgcctgccgcccagagcgcatcggccggacggaatgcgagcgtgtcgggcacgatatagtccccctcgaagccgcggcagcgcatggcatccgaggtcgtcttcgctgcccgctgcgccttcaggagcacgacgccgccgacgccgcccagggcgcttcccttctcgtggttcctgccgacgcttcgcatcttcaaggatccgagcacctcgagcgccgtctgtccgaggtcatagatgctcttcaatgccagctcgacagtcaggatgaagacattcggcacatggaaggcacgaagcgcccccgtgagctcggagagcggcgtcgagagcgccacgatcattgcgatcgagaccgagacgaagaccttcgtgccgataagaagcgccgagctcgcctgtcccagaaggatggccggaagcatcaggagggcactcaggatggctgctcccgcagatgtcttcaagcagcgcgaaagcgccttctgtggcagcagtgccatgcgcacgagcgcgacagcaagaagcagaagcgtgaacgcgaagttcgtggcacaggagccgaggatgatggcaagaaggccgagcacgagcttcacgggagcagagggagagagtgcccagggcctgcctccatcaaacctcaggcgtgccaggacccctgccacggccttcatgctcttgcgtatgaatgaatccctgtcagctgcaggctcgtagcgctcatccgtcagcagccactcaggcagttcccgtgcctcttccctatcgcgtgccaaaatcgaccttctgctttcctcctgctgcgagaagccggaacacgatcacgagcacggcggcgccaatcacggcagaaaggacatagccagcccagtctggaagcgccccgaacgaatagtcaggaatgagcgcctcccacatccagccagaggaaaggcctcgaggtgcataaccgaccgcagcgctcacatcttcgggcgcccattctccccacgcatcgccttcggccagaaggccgagcggcacaagcacgatgagggcacacatcaaggctgccatcgccctgctcgagcgggaggcgtccttgtccgtcgcaccgagcccctcgattccgaaggaaggggcagccttcctcacataggccaggatgccgaccgtgaagattgcctcggcagcgcccgccaccgtgaggtgccctgcaagcatcgcagggaccgagacccagagcggataaggacaatagagcgcgttgccggcagcatccgtgaagaggaggggctggatgccgaactcgatgccagctgagagcgccgccgcattgattgcgacgtaggaggcaatgcctgcagccacaagctcggatctcaacgaggacgcatccttcttccggtgcatgagccaggtatagatgccataccccacctgcggcaggacgaaggccatgttgaagcagttcgcgccgaatgccagaatcccgccatcgccgaaaaggatggcctggagcgcgagcgcaaccgagagcgaaatcgtcgctgcccaggggccaaagagtatcgcgatcagggtgccgcagacggcgtgccctgtcgtgcctccgggaatcggcacattgaacatcatcgcgaggaagctgaaggcagcagcgaggcccagaagaggcatcttgttcttcggcacggtctcgcgcacgcgccttgtggcatggacccagacggggaccatggcagcggcaagcacgccgcaggtcgaggggctcagatagttttcggggatatgcatgcgtgccctttctgaatcgcgtcggatctgctccttttttatagcagagtggacgcagggaagccatcctcttggcaatcaaaaccgcttgcggaaaacgcttgctcatcctgtcttggcacaagaaagctcccgccggcacctgccagcgggagcatcaagatgctgcttctctcttttaggcgagacgggccttcacagcgccagccagatcttcgaaaggcacctgcacctgctcatgcgtatccatatcgcgcagcgtcgcctcgcctgctgcgacctcgtccggaccgataacgacgcagagacgtgcatggagcttgtctgcctgcttgaactggctcttgagcgagcgtccctggtagtcagcctccgcacggacaccggcgttcctcaaggcgagcgtcgccttgaagacagcctcgcgctcctctgccgacgtgcctgccacatagatgcattcaggctccggcgtctcgagcgtgctgccctgggcagcaagcgcaagcgcgatgcgctcgaagcccacggcaaagccgatgcccggtgtcggctttccgccttcgagctccatgaggccatcatagcggccgccgccaccgatagcgccgacgccggcatcggtcgcctcgacctcgaagaccgtgcgcgtatagtagtcaaggccgcgcacgagcgtcggatcctcgacgtaggcaactcctgcctcgtcgaggtacttcttgaccttctcgtagtgctcgcggcagtcgtcgcagaggttgtctgtcacgagcggtgcggacttcatgacctcacggcagtggtcgttcttgcagtcgaagctcctgagcgggttgatgtcggcacgctcgaggcagtcctcgcacatctcgtccttgtggtcatagatgaactggcgcaccttctcgcggtaggcaggacggcaggctgcatcgcccatcgagttgatcgagagcctgagcttcgatggatcgaagccgagacgcttgtagaactccatgagcatgatgatgcactcggcatcggctgcaggatctgccgcgccgagccattcgacaccgacctggtggaactggcgcaggcgtcccttctgcggacgctcgccacggaacatcgcctcggcataccagagcttcgcaggcgccgctccctgcggcacgaagttgttctccaccgcggcacgcacgacgcctgccgtgccttccggcctcatggccatgcgctgcttcggcttgagtcccttctccgtgcctgcctcgagcaggttctcgaagagggcgcccgagacgacgcggaacatctccttgcgcacgacatccgtcgactcgccgatgccgtggacaaaggtatcgacctgctcaatggcaggcgtctcgatcatatcgaagccataggtgccgaagaggtcgcgtgcgacatcctgcatatgctgccagctgcgcatgtatccgccatagaggtcctcggtaccctgaatcttctgtgccatcaaaggctccttcctgcatgctgaagcatgctctcagccgtggccacaaacagaggagctcctgcttcctgccttccacggccgtgagcgaaagtatagcgctttcgcctcattcccccatcatgcacgatgcctgccccacagaggagacaggcatcgaccggttcgataagtgtctttccttactcggcgtgcgcgccgcccggaatctcgccgccgcagtgcgggcacctcgtggcgccttccttgacctcctcgaggcagtgcgggcacttcggtgccttcttctcgacctcttcctccttcgtgtggaagagcttgtcctctgcctccttgaagcggttcatggccttgaccatgcagaagacgatgaaggcgacgatgaagaagttgatgacagccgtgatgaaggcaccgaagtcgatggaggtgcccggcacgacgaggcccgtgacctcggcgccgccgccggagatgaaggagatcagaggattgatgatgttcgtgcagagcgatgtcacgatgttcgtgaatgcaccgccgatgatgatgccgactgccatgtccatcacattgccgcgggacacgaactccctgaattccttgatgaagctgcccatgcttgcctgcccttcgattcgggttcctttcgtccctcaactgtatggcacttttcagctccctcacctgacaaatctggagcaattctcagagatgtacagatgcagccctcttctgcatgaaaaagcaccctgccgaagcggggtgccaagtggttttcaagcaatcttcgaaaccagctagagcggtcaatctgattcagaattcctcactctctgcaggcagcgtcctgaagtctcttgcgagcttccgcatgtgcatcgacgggagaattcgccaagacaatatcgatgattgtcttgaagaagtgctcacaggacagatctggtggaattgccttcactgcacgctcaggaaatgtcactgtagcaacatccgtccatgaatttgacttatcgatagcgtcatcatcggacacttcaatatcggcgcttgtatcccagtaggcaatcagcaatgcaaccgcatcatagacctcgccattccgcgagagctgtctcagcatatgtgtcgccttctcaaatgccgatggctcatccaatatgctcgcatgcgccaggaacacgaaaccatgtgccgcaagcggatagcgttcccggagattcttgacatcgccgtaggcttcctcgaagcggttgggcagattctttccaaacgacgcgctcatcgttttcgtggacacaagcatttctgggcccgagagccagtttgacatgccgacatcgacctgcttggtgtagaccgaacccatgacatttgcatctttctgggcacccccggcatgcatcagcatttcagtttggggaggagtcagagaactgaccgcgccaagcgcatgtaccaaagaaggatccattgcgcgaggctcctccatccgcggccagatgcattcatcagtaaagcccgcatgttcaaattcacgtgcgagccacaggtcaagggcattggcaaagacacccgaacgcacgctagatccattctcaaccggaattgccagcaacgacctgagaaagccatagtccagctgcggttccgaagactcgttgtagaacggtgttgtagtgttttcttcccacgcttgcatgatgttattgaatacattcatcttgtctttgcgacttgccatcagttctcactcccatcggatttccgtgtctttgacctcctatgtcttctcgctcgaagctcgagcagagcgccatgagcaagctgagcttccgatgcagtaaccccaagttcaggcagaagtattccatcaacaatcaatgtggctgcatcccgacgcccctcatcaagcgcctcctcgattggacgagttgcctggcgcagttttgaggcgcatccaagcaccagccctggagctggcagcagcagttttcctgcttccctcggttccagcttcagaatacctcctccatacgagcgtcccacaagttcagccgaaagcaacgtgaacgtcgaaagcgctgcaacagggagcagttcagcaatatctcgaggcatcccttcgttaagggtcaagccgtgtattgaattcaggtagcagacgcccgccttgttgtggcatagattcggaccgataccgttcatataggtgaagaacaaatcacagtcatgaaggccgggcaccatccaccatggatttctgacacggcacttatatgccttgtcgatgccaagctcttctccccgctctatatatgcttgtgctgctgcagacaaagtattaccaggatggaataggtatatgcgttttcctgaatccttgagcaaattgaactctttgtccccgaaagacagccttctcagatgcctagagccaggagggcagattggaataagttcgctttttgacagacctgcatccatggcctcccgcgccgaaagagcaaagaatctattagatcccgtaaccgctccaagacgcaggcttccataatccgatagcctcgccaacttctctgtatcaagactttccagaaagacttgagcatccagagcgttctgcccgattggccagcgcgacgagggctctaccggagcagtaaacacagcgttggaaccaagctcttcaatggaatcaacctgcgacatatagatgcgggagctgcttcctcccccaaagccacttgcataaagcagtacgacctcttcctgcacttccgggaatacaggttgttcgaatagagtgacctgtatcttcgagaagtttctgagaagaaacgctctgaccggagcagcgtactgtacagtcagcagctccgcaggcaagacaaagccaagtcgacctcctggcttcagaaatcttgcggcatgcaccacgaaaggcgcccaggaagacgcgagcgcatcaatgcgtactcccgccgccaatgcatcagcccgtgcttttgcacgttccgctccagcaaattcctgatatctgatatacggcggattgccgattatggcatcgaagcgaaactcagaaggctccatatcgaagaaatcgcccgtcagcaccgtcgccgtgacacctgcagccgaaagcttcgcacgggcagcttcagcgctctcttcatgaatctcattgccaaagagctgagtgccaacgctatctggacatgctcctagctgcacaaggcggtcggctgcagcgaggagaaagatcgcttccccgcaagaaggctcaaagacggcatcgtatttcgatgcgacagcaaacctcgctatggaatcagccagacctcttggggtgaagaaggctccacgcgactttcttgaggaacggttgtcatcggcctccagtagcacagatccgtatgccatcaataacctccttacattgtctttctggaatattctaccaaggccatctgacagaaatatcgtgcctcgctagcagctcttctctgcatgaaaaagcaccctgccgaagcagggtgccaagaagacagatatgccttagaagctagtcgaccttgatctcgtggacccagccgaacttgtcctcgatctcgccggactggatgccggtgagcgtctcgcggagcttcttcatgacagggccgacgtgatccatgccgtagacgaccttctcgtcgccgttgtcgacctcgcccaccggcgagatgacagctgcggtgccgcacatgccgcactcgacgaagttgccgatctcgtcgaagcggacctggcgctggacaaccttcatgccgaggtagtgctcagccacatcaacgagcgagcggcgggtgatggacggcaggatggagttcgtggcgctcttcggaacgacgagcgtgccctccttgtcgacgaacaggaagttcgcgccgccggactcctcgacgtaggtgcgggtctggggatccaggaacatgttgtccgcatagcctgccttgtgcgccaggacagacggatagagcgacatagcgtagttcaggccagccttgatgttgccggtgccgtggggtgctgcacggtcgtactcggagacctgcaccttgaccggcttcacgccgcccttgtagtaagcgccgaccggcgtcacgaggatgcggaactggtactcgtcagcaggcttgacgccgatgacgtcgcccgtagcgaacatgagcgggcggatatagagcgttgcgcccgtgccgaaaggcggcacccaggctgcattggcacggacgacctcgtcgactgcctcgacgaaacggtcctcagggaacggcggcatcacgatgcgctctgcggaatcgtgcatgcggtgggcgttctgatcgggacggaagcagacgacacggccatccttggtcgtataggccttgaggccctcgaagacctcctggcaatagtgcagaaggccggcgcactcggaaagcgtgacagtgtggtcaggggtaaggccgccctcgtcccaggcaccatccttatagttcgagacgtagctgtaatcggtcggctgatatgcaaagccaaggctctgccagtcgatatccttcttctgaaccatgacacgctcctcacgcaatcgactcgggagccagcccttcttgcccggctccgattgtgtgaagagtctacaaccgtaaccataatgtggcggtaggtggaacagccctgaaacaaagacggcacttcacctacatctcagtgccctgccatcaagttcctcatggccacgcaggttccgccattttccacagctgccctgctacgatagtccaaacatcagaaaggatctgcccatgcgcatgttcaggaacgattattcggaaggtgccgccccagaggtgctccaggctctcatcgacacgaacgaggagcagtgccccggctacacggaaggagatatccactgcgagtgtgcccgcgcgctcatccgcaaagcggtcggccttcccgatgctgcggtcgagttctgtgtcggcggcacttcggtcaacctcatcgcagtcaccggcatgctccgtgactgggaaggtgtcatcgcaaccccgcttgcccatatcgcgacacatgagaccggagctgtcgcagcagccggcaggacgatcctgctcactgacgatacagacggattcgtctcccctgacgctgcagaacgcatctgggagcgccagtgcgcaggaggcaggcatatgacaaagccggcgctcatctacatcgccgacacgaccgagatcggcggcgtctggtcccacgagcgcttctttgcgcttgcagactgggcagacgcccatgatatcccgatctatgtggacggcgcacgtcttgcaagcgccctcgaagcccgggacgcggaccttgcgctcgaagacatcgcgaagcgcgcggccgccttcacgcttggcggcacgaaagatgggctcctgttcggagaggcgctggtcttcacggacgaacgcctcaaggaagcgttcccctatgtccagaaggagcgcggcggcctcatggcaaaaggaaggcttctgggcgtccagttcgagcgcgccttcacgccggacgcggatggcgaccttccctggctccgctatgcacggcaggcaaatgcctgcgcagagcggctcttcgaaggcctctccgggctcggcttcgagccctatggcggacacgattcgaaccagctcttcttctatgtgacagaagcagaagagcttgccttccgcggtgcctgcggcgccgagaccatctccgtgctccccgatggcaggcgcatcatccgattcgtcacgagctgggctacgaagatggaggatgctgacgagctttccgccttcgcctccactctcaggagccgaggatgagtgtctcggacagaaagaggctctcctctgcctatgccgtctctgcccttgcagtcctcagctgtgccctctggggatctgcgattcctgcgatccgcatcggctatgcgctcctcggcatctcctctgccgacgttgcggaccagctcgtctttgccggaccgcgctttgtcctgggcggcatcatcgtctatgtcctccagggcgcaaggaccggcagctggcacgccaccccggccgagcttcgcgctgctgcccagatcggatttttccaggtcttcgcccagcagcttctgggatatgtcggccttgcccatgcaacaggcgtctcgggctccatcgcgtcgggtgcaggcgtcttcatgatgcttctggcctcctgcttcgtcttccgtctggagaagatgaccctgaacaaggccctgggctgtctctgcggctttgccggcctcctggtcgcgaccggaggcatcggacagtccagccgcttcggctggggcgagaccctgatgcttgcctcctccgtcgcaggtgcagcagcgaccgcgctcatgaggaagaaggcacagtcagaggaccccctcaagctctgcggcctccagttcatgctgggcggagcctgccttctggcggcggggctcatcctcggcggcaggctcgagatagccaccttcgcagagcttgcggtccttgtctggcttgcggtggtatctgctgtcggcttctcttcgtggagccttcttctcagggacaacgatatctcccgcatcgcgccctaccagttcctgattcctgtcttcggcgtcgcgctctcgctcgcgacgatcggcagcgagggcacgcctgtcggccctgcaacggcgcttgcccttgtcctgattgcagcaggaatcatcctcgcaaacagaagagcttcctccacatcatgaagagggctcccggcagatgccggaagccctcccgctcttccttgtgcctccctcaggcttcggggaacaccttgtcgagattctcgcggacgatgtcgcagcttctcctcatggcacggcgctcatcgtaggtgaggtcgatctcgagcacctgctcgacgccctggtcagacaggatgcagggcacgccgatcgagatgccggactcgccgtactcgccttcgaggtgagccgaaagagggatgacggcacgctcgttgtgcaggattgacatgatgatctggctcacgatggaggcgatgccgaactccgtgcagcccttgcccttcacgatgcggctgccggcctccttgacctgcttcttgatatcgtcgaagtcgagctggctctctccgcctttcctcatcgacaggtactcgcggagctggatgccgccgacggagatgtgcgacgtcgggatgaacgacgaatcgccgtgctcgcccatgcagaacgcattgacctggcgcgaatcgacgccgatctcgcggccgatgatgccgcgcaggcgggcagagtcgagtgccgtacccgtgccgaacacgtggccgcgcggcagcttcatcgtgcggtacaggtactctgcgacgatgtcggacgggttcgagacggagatcaggatgccctggaatccggagtcgcggatctgggggacgatgccatccaggacctgcatcgtggcgccgagcatctcgagacgggtctggcccggcttcctgctcctgccggcagtcatgataacgaaatgggcatcggcgcagtcggagtagtctccggcacgaatctcgaacgactcgccgaggccgcttgcaagatcctgcaggtccatggcctgggcctctgctgcctcgcggttcacgtcgatgaggacgatctggttcacgaggtgacggaacatcaggcagagcgcgcagtgcgaaccgacgcggccagcgccgacgatcacgaccttgcgggtatgcatcttcttctccatggagcaacatccctttccgatagaaacaggcaggcatcgccgcctgtacagatagcttccgacgtggccacgatagcacgctggaatcgtttccgcacgtaaatgcgcacgtagaaccgtctgccgattaattcagcccttcgggaaatttctccgcttgccagatcagagctctttcacccgcacgcccaggatcgcaaggacaagcggcgcctggccgagcgagacagaagctcccttgagctctgcaaacgtatcggagatgcggatgctgtcgatcgtggaggatgagaggtcgcatcccttgaggctcgtgccgaagagctcggcacgcgtgaggtcggcatcttcaaatgcgaggcccttcgccttcatatggtcgaggcttgcctcccggagtgcggaagagacgaacttcacatgctgtgccttcgactcggagaggttggcatagcccagaaggcacgatctgaacgagacgcgctcgatataggacccatggaagtctgctcccgtgaagcggcagtcagaaagcctgcaatcacgcaggaagcttcttgccatatgcgcacccgtgaagtcgcaggacgagaacgtgcagccatcgaagcttgcccgtgcccagcgggtatctgcaaacgagacctggcggaacgtgcagcgctcgaactctgcatggccaaaggatccggaaagcgtctcgcgcgcaaacacgcggccggagatgtcggcatcctctgccatgaggagaacgtccaggctctccccttcttcctcgtcgaagagatcgtccatctcgtctgccacgcggctcatgtgccctccttgcctccataggtcatcaagcatataccaagcatgtctggaacagagaaaggggcaccttccggcacccctcgatacgtttcctatgtctcagaagatcaggcagacttcatgacaatggagcggacaacgcctgccaccgcatcgatggagtccaggcactcctccatgcggtcgaatatcctgagccatcccacgatatgacctggtctcgactccttctcttcctggaagagcttcctcacgccgttctcgtacacggaatctccctcatcctcgatgtgtcccatcgagatggctatctgcatgcattccggatcgtccttgtagtgcggaaggcggtcgatcatctcatgcatctgcttggcagcgatgagcgtgagctctgccatctggacagcctctgagcgcatatgggagacgttgaagagatcgagcctcgtcgagacgcccttcatgttgtcgacgacgtcgtccatcttgagggcaaggtccattacatcgtttctgtcgaacggcgtgatgaaggacgtatagagctccttcatgatggcctggacgcgctggtcgcattccgactcatggagcttcatctgcggaatcatgatctccgtctcgggatagccgcgtatcagcttctcgtagtcgactgcgcactcctcgattgcagccgcaaagtccttgagcttcgtgtagaacggatcttctttcttcatgcgggccatgggccaccattcctttcgagatagggattcgcgtctagaaccacaggaggaagagcttggcgaggacaaagccgatgatgccgcagcccgggaacgtgaagagccaggtgtagaccatgtccttcgcaatggcccagttcacggagcgcacgtccttggcagcgccggcacccatgatcgcggcggtcttcgtatgggtcgtcgagaccggaaggccggtgagcgtggcaatgaagagcgaggccgttgcagagacagaagcggcaaagccctgatacttctcgagcgtcaccatctccatgccgaccttcttgatgatgcgcttgccgcccacggccgtgccgagcgccatgacgccggcacagaggatctcgatccagagcgggaagccgccaaggtccgagatgctcgtgcctgcagagagggcgatggcaagcattgccgtagacatgaacttctggccatcctgcgcgccgtgcatgagggcaacgcccgctgcacctgcaatctgcatcgtgccaaagaagttgttggcccgtcttcggtctgcatgccggcaggcatgggggatgatcttcgcgatggcccagcctgcaagatagccgagcacggtcgagagcacgaggccgtagatgaccttcgcccattcagagaaattgacgccttcgacgccgcccgagacagcgatggcagcaccggtgagtcctgcaatcagggcatgggattcggaagtggggatgccgaagatccaggcaccgacaccccaggcaacgatgccgaccgtggctgcagccagggcgatgagcgctgcatgggtatcgccgccgaagtcgaccatatcggacatcgtgtctgccacggctgtcgagatcatggtcatggctaccaagcctacgaagttgcaggcaacggacatggcaatggcatgctcgaccgtgatcgagcgtgtacccaccggctctgcaatcgcattcgcggcatccgtcgcgccattcacgaagatggtgccgagaacgaggatgatcacgagagcgaggaaggggttggccgagaccatgccaaggaactgcgagaaggtaatcaaaggttgcctccacagactgcgtctgtccgctccgatataggcagaagcggcttacgtaatggaattgtacgcattgcgtaaatccatcgtaagccgctcgccgataccttacactccgctgacaaaagaagtcagagcttctgccttcgctgttccgccccttctatcccagcgccacatcgaggaccatcatgacgacaaagccaagggcaaaggagatggtcccccaattcgaatgctccccttcgctcatctccgggatgagctcctccacgacgacatacatcatggcgcctgctgcaaaggagagaaggaccggcatcgccgagacgatgaccgaagaggctgccacggtgatgatggcggcaatgggctcgaccgcgccggaaaggacgccgagcgcaaacgtcttagccttgctcatgccttcagcacgaagcggcatggagacgatggctccttccgggaagttctggatagcgatgcccagcgccaaggcagcagcgcctgcaagcccgacgccggcagagccttcgaggaccgctgccatgacgacacctaccgccatgccttcagggatgttgtggatcgtgaccgcaagcacgagcttcgtcgtgcgggaaaggccagatttcacgccctcctcctgtccatcgagatgcatgtgaggtgtcagcgtatcgaggatgagaagcagggccatgccgagaaggaagcctatcgcgcagggaatgaaggcaaggctcccgagcgcctcttccgcctgctcgagcgccggggccaggaggctccagaacgaagctgcaaccatgacgccagccgcaaagccccgagaatgcgctccgtcctctcggagagcccgtccttcatgaagaagacaagcgccgcaccgaggcttgtgccagcaaacggaatgaggatatagccaagcatctctggtgtcatttcacgtcctccttcgtgccttccttcttctcctgtgcatcaagatattctatataacgctctccccagctgcccaccgcatcgagcaccggctggaaggtctggccaagctccgtgagctcatactccacacggggaggcacctcgggatagacggtcctcttcaccatcccttctgcctcgagctgcttcagctgcgaagagagcgtcgagtgcgtaagctgcggcatcctgctctggagctccgagaaccggagcgtcctttcgctcagatgatgcaggatcacgatcgtccacttcccctggagcacccactgtgccgtcacgaaggggcaggtgccgaaatgctctggcttctgtcgtgccatatccatctcctttctgccataggtatctgaaaacataccaggtagcgagaaaaaacattattgctatcgctttagtgtcatttatagtacaggacaacaagcaagtccagaattgatacctggaagcgagagggtacttatgagcatgaccagcaccgaaacacgccagcccgccctcttcatcggacacggcgacccgatgatggcactcaggcatgacgcaatctcggaaggcctggcctctgtcggcgagcgcctcaaggcacaccatccgaaggcaatcctcgccgtctcggcccactggttcacgcgcggcacgctcgtgcagtcagacccgacaccccgccaggtaaacgacatgtacggcttcccgcctgagctctacgcaatccactaccgtccctctggctcgaaggagctcaccgagcgcgtgctcgagcttctgggcgatgatgtcgctgtcgatgatacctggggcatcgaccacggcgtctggacaccgctccatcacatgctgcctgaggcagacatcccggtggtcgagctctccgtgaatggcctcaagaatgccaagtacgcctatgaggtcggacagaagctcagcgccctgcgcgatgggggctttgtcgtcctgggttccggcaatgtcgtgcacaacctgcgcgaggccgactgggaaaacccgcatggcacaccccagaacctccgcttcgacgatgcgatcctcgaggctgtgaagaagcgcgacgatgacgctgtcatagacttcgagaagctccctgaggcagcctacgccgtgccgacgccagaccacttcctgccgctcgtgaccgtcctcggcgcagtccagggcgaggaggcagaagtcttcaaccatatccagaaccttggctcgatcagcatgacaagctacgcgttcgggctctgagaatcgggaatatagcaagaaaggggccgcaatgcggcccgaaggaaaggaatgatcaccatggcagaaccgaagatcttgatcgttgtgggaacactccgcaagaacggcttcaacgagcagcttgcagagaagatcgagaagctcctcgagggcaaggcagaggtctcccgtctcgactatgccgaccttcctctgatgaaccaggacctcgaagaccctgagcctgaatccgtcaagcgcatccgtgacgccgtgcgcgaagccgatggcatctggttcgtgagcccgcagtacaacggctcctatccgggacacatcaagaacctcgtcgactggctcagccgtccgcttccgggccagggccgcgactctgtcgtcattgccggcaagaaggcaacggtctccggtgccggtggccgtaccgccacggccgagatgcgcgagatgctcgacaagctcctgcgcttcgtcggtgtcctcgttatggaagagggagaggctggcatcgccctctccggcgagtcctggggctccggcaagcttgtcctcggccctgctgatgaagaggcgctcgaggcccaggccaacacgttcctcggcttcctcgaggcatagaagcaagtcctctggctcaatgacaggagggtccgctgcatgccctgcagcggaccctccttcttcatctctggctcaggctcagtggatcatgttcgtcatgtggtagctctcacgctcaggaagcccatagcgctcgcgtccgagctcgatcgacctcatgaggaagaccatgttgcgcgcgaggtttcgggcaacagccatgccttcctcatcctcagcagcctctcccctcttctggccgaagacgtcggtccagtagctgcccgaggcaactggcatgccggagatcgtgaagtacttgtagagctcatcgagcgttgccacagtgccagcacggcgtgcgacggcgatggcgccgccgaccttcatccgcttgtcgaagtgcgtgctcatgaagaggcggtcgagcacggcgatgacggtcgcatttgccgaagcataatagacaggcgtcgccacgacgaggccatctgcctcctcgaacttcggcgcgatctcgttcacgacgtcgtcgtagacgcacttgccggtctttgcgcatcctctgcatgccatgcatccgcgcacggccttgctgccgacagcaatctcttctgcctcgacgccttctgcagcaaagatcttctccatctcggaaagcgcaagcgccgtgttgccatgaacacgcgggcttccgttcagaagcacgaccttcatgttccctctccttccaggaaggcccctcgccttcccgcagttcctagaattccgaaaccttcttgcccgccaggatctcttcgagcctgtcgtggtcgccctgcgtcttcaggagcctccggtagcgcgaagccaggtcctgcacggcgtcgcgctgaccggtggcaactgccttctcgagcgcacgcatgagggcgcacttgccggtctcgctcggaccgtagtgctcccctgcacgcctgaggcggcgcttcgcctccttggagtcgatgcttgcaaagacgccaggatgatgaagcccctcatcgagctgcgcaagcatcggatccacatcggcgagctcgtggtcggtatcgaagtccttgaaggcaacgaggtgtgcgacgccgagcggaatcctctgagtgtggatcaggttgagcgcgcggtagaagtggtagcccgccatatcgatatcgcgggcaatcaagggataggtacgctccagttccttctcgagctcatcctcgtcgcgcttcatatcgaggaaggatgcacgcctcagatgaatctgcgcattccagggatcccagcgaagcgcctttgtcgctgtgtcgaggccttcgtcggcacggtcgaggtagtagaggcagtctgccttgagctcccggcccagtgcctggacgccgagcgatggcatatacccatccggcctgaatgaggcatccgtgagctgtgccagctcgatatcgacctcgtccttgaagtcatagaccgaagaatctgcatcggggcccttgtcagccaggtcgtcgagcaccgtgatcaagggctcgagcgtatcgagcgccagctcatagtgctcgcgctggaactggcctgccgccttctggagccggtccatctgctggagtgcgaagacctggagcatctcctgagactgctcaggcgtcatgtgctcaggatcggggatggcaaagccatcctctccgcgctctgcagctgaaggattgattgcgttgtcgagcttggcacgctcgcgctcgcgttccttctttgcggcctcctgggccttcctggcctcgatcatctgattctgggcatctatatctgccttcgagcgcacctggatgccgtgaagcttcttcgtgccgccctggggctgtctcaaatctggcatgtctctcccttgctggtccatccatcagagagaagcgtacccgaagatgggcggctgcaaagacgtgatgaggaagcgcacagagaggccacgctcagtctgcatcttccccgatatggacgatcctgccgccgtggcctgctgcagcaagacggtgcgagaccgatatcgtggtcctgccctccgctgctgcatcgagggcggagagcacctgcgcttcagttgccggatcgagatgcgatgtcacctcatcgagcagcagaagcggcggatcgaagacgatggcgcgggcaatgcccagaagctggaactggccttccgagaacgtaccctgcgtgcagggcgtcgccaggccctctggcagggcaagaacgctctcccagaggccgacgtgctcgagcgctgccttcgcctgctcttctgtgacgcgcggatctcccagcgtgagctcgtccaagactgtgccctggatcctcctgaatccctgctccacatagcccagagtcttcctgcgctcatctgctgcaaagcttcccgcaggctcgccgaagacagagactgtgccgctatccggctggtagaggcccataacgagattgagcacggtggacttgccagcaccggtgcgtcccatcaaggtgacgcgctcgcccggcgcaacgctaagcgagaaatccttgagcaccggtgcatccttcttgtagccgaaggtcacatgcgagagtgcgacagctgcttgcctgtcttccgcgcctgtcttttccggaagcttctcctccggagcctcgaggagctctccgatgcgggagatggcagctcctgcatcctggatggactggatctccatgccgatatcggagatgggcgtgaagacgttgccgacgtagctgatggccgtgacagcgccgccgacactgacaccgaagaatgctgcccaggcaccacccgagccagcaaggcacatcatgagggcaatgaccagagaggagagggagatgacaacaggagagtacacggcatcgcagaagttcgagcgggtctgcgccgcaaacccgtcatccaccgccttgccgtagcggccttccatgaaacgctcggctcccatgagctgcaccatgcgaaggcagcgcagggtctctggaatctgcgcgctctcgcgggcgatggcagagcgcgcatcgcgccgtgcctctctcgtcgtcttctggatccagcgcgtccagagcgccaccacaggaagcgcgatgaggaccaggatgccgagaccggtgctttcgaggaagatggcaatgacgatgcctatgacctgaaaaacatcggtgatcatgccgacaatgccagaggcgaagagcgcctcgattgcatccacatcgttcacgatgcgggcagagatcgcccctgcgtcatgctcatggaaataggcagcaggaagcctgtcgagctttgctgccgtggcagagcgcagcttatgcgtgaccttctggccgaagatagcgatggctgcttcctgccctgcccctgccaggccctgtccgaagaccgctgcgacatagaggattgcaggcgtgagcacggaggcattcttcgccaccagctcatcgacgatgaggcccaggatatagggcggcaggagcgcaagcacgatggaggcgacaatcacggcaatgagtaccaccgtgaggagcgcatgttccctcatgcaggtgacaaagacagcacgtaccggatgcgtctttctctcggatgccttctccatcatgcctcgcctccttccgagagctcgaagagcgcacggtaggcaggacacgtcctcatgagctcttcatgggtgccgacagaagccttcccgtctgccaggcagacgacctgcgagagctccgggaagtgcgcaagacggtgcgatatgaggatgacggccgtgccgccttccttggcccaggactgaagattgcggaatgcttcatcctcagttccagcatcgagcgaggcgaaggggtcatcgaggatgcagacggaacgcctgtggcagagcgtgcgggcaagacccaagcgctgccgctggcctccggagagtctgcttccgccttcgtcggcaagggtcttctccccttcgggcagagccttgacctcatctgcaaggcacgcttcctgaagtgccagagcggcatccgcaccgcttccgaggcagacattgtcttcgattgtggcatcgagaagctcagggtcatgccccagaatggagaagacgccctctccctgaggtgtgaccgtgccttcatgagggagctctcctgctatgcagcgagcaaggcagctcttgcccgaggcgacaggaccgcagacaccgacaatctcgcccggcgccacagcaaatgacacgtcctcaaagagcggcttctgcccctcccagccaaagcccaggtgctcgatcctgatgccggaaggctcagctgccttccacttttcctcctcatgctctgacaggtagccttcgatccgcttccaggagacctgggctctctgcaccgcattgaagagcttggctgcatgggaggacttcacggcgagcttcaggaacacggagacatacatcgtaaatactgcgatatcccaggtacccgagacgacgttctgggcaccgaggatgaagatcggcagcacgcccagaagcgctactgcctggtagagcggcatcagggatgcagagagcacattggccttggcctctgccttctcgtagcgcgtgagctcatcctcgaagagatggtcacgcacctcttcaaggccgaagatgcggtaggtcagcgctccttctgccctgtcgagagccgtggcagacatggcagagacttccttcttcgccgttgccacggcgcctgtcacgacacccttgagccgtgccgccaggatataggagaccggcggaaagatgagtgcaaggagcgtgatgcgcacatcctgcgcaaacagcacgacaaggtagctgatcatgaccacaccggtatcgaagagctcggtcgtgaacttgcgcatgccctcgacgcagtcatccacatcggagagcgccttggtcatgacctcgccgcgctcggattcggtctttgcaatcttgccggaaaggagattgcggtagagcgtcttcttcatgcggcggtccacatcgtttgcgaacctgcgcacatagaggcgcttgagtgccctcatgccctgcacgaagacgatggtcaggacatagaagaggcagagccgaagcatcgaggaggcatcagagaggccttggaggatatctgccaggcactgtgccatgaggccctcgagccagggacccaggaccatgccgacgttgtagaggatgcctgtgatcgtgacgacgagaagcgtcttccactcatcacggaaatacgtgaggatggaggccttcttgtctcctgttccggtgcccaacgatatcgcctgccaaatgacaagaactgaaatggagctgcaaggaaagcctaccttagcacgcaaagataaacaggaggcaaaggcaccagaatctggcgctcaagacgctgcttctgctgagacgggtatataggcacttgcatatcactcagacagaaagctgatttctgcctgccgcatcaaggaggcagcatggagactgaaccactgcgtgacaagaacggcctcactgaggaggagttcctggccgcctattcgccgaagaactatccaaggccctcgctcacggcagatatctgcgtcttcaggaagaaggagggtaaccttgagcttctgctcgtgaagcgcggcggacaccccttcctgggatgctgggcaacccctggcggcttcgtgaacccgaaggagacggcagacgaagcggcggcacgcgagctcgaagaggagacgcatgtggcaggtctcgccctcgagccggtaggactcttcagcacaccaggcagagacccgagaggctggacaatctcctatgccttctgcgccctcgacgacactggcgccatcgcgaaggcaggagacgatgctgccaaggccatctggttcaaggtcacaccgagccagaaggctggcaggacgacgcttgcgctcgatgcaggagatgcccatctcgagacatccttcgcagcccaggaagcccctgtcacaggaaggctccgccccaaggacgtggaaggtcagggccttgccttcgaccatgcagagatcatagctgcggcctggctgacgcttcctgagaacgtgaggtcctagcgtgcagaccttctcctatgatgcggtgatccaggcagtgcctgagaagggtggtgcctatgtcgcctttccctgcgatatccgtgcactcttcggcaagggccgcctcaaggtccatgcaaccttcgacggcgtcccttacgacggcagcgtcgtgaacatgggcgtgaagaacgatgacggaacgatctgctacatcatcggcatccgcaaggacatacggaaggccatcggcaaggagccgggagatacggtccacgtggagatcgtgcctgcataagaacagatgatagagatagagatagatatagaagaagggagcctgcctgaaagcaagctctcttccgcatgcctgcaatatccgtcgctccgcagcgtaccagattgagaaggtacgcctattggtcagcggccctcacgattagtgtccaaacagctcatcatggcttccagttcgctcaaagaatgcaaccttatcgttggatgaccatatgacaagccagccacctgcattcgcgacatggcactccttgcgcccctcccaattgcctgagagagcatgcatattatggcgacgtctcagctcttcaagcgtgtcaggagtgttctcgacaacaaggccgatgaccttctcaagctcagacagatcccatccgcgccttccagctttcttcttgaggtctcgtctgaatgctttcgaatagtcagcagtgagccgagctatcactccatcgccgattcgatgaggctatgagcgtccgtgaacctgcccggttttccggaagccagaaatgcattgccctccgcaatggcatcagcgctttcagcattcggctcttcaggtgcaaatgtcagcggaatgcggtgtgtgttgaccatctgcttgtagaaagcacgcgtaaccgaagagagatcgagaccatagtattcagcaacttccgacgcgtcatgcttgagattctcatcgagacgtatggtaagtgtggatgaagccatcattgctccttccaaatggcgtgtatgtacatctttatatttatgtcattacattctatatcatatatactgcccaacatcggaccatacatattcattcaaatcgggtaaatggctgagtacctccagcatagttaggctccctgaactgtaaacggcttaggcaagctcgcaggaagcttcggctggaccgtggccgtggctgcgatgccggagagcgggacatgcatgaggcacatctcgtgaggactccatgcaggctcggagagctcctggtgctgtatctccagctgtaggagtccgcatatgactgcaggtgcttcttggagaggccgtggaaggctccctccacgtatgccttgaagttggagatgaccctgtggaccatggggagcgaggcatcgccgtccgagctgtcgtattccttctgctcgagccgcggaaggacgagagcccggcagctatgccgctcaggcatccgcccttatcctcgatgcatggcagaggtggtcgtgcccgaactgcgccatgagtctcccgagcagtcctgcgcgcaccggatggcgcaggagcccctcccggcaggggccctgtcgacggcggcaagcagcgctgctgctccgtgccccttcccctcgtgcctccggccctcgcgcctatagaagtcgtccgcctcgatgcagtcagcacgaggacgttgaaggcactccgatctggccatcgcgcagcggtgcgcgcaaggacgcgccctgcgtcttgtactgcagcctatcgggcgctgcagggagcatgcgctgatgcctgccttctggctcgacatagccagatcgccacgaacccttcctgagctcgaggtgggtcccttccatcatcgtgcctgcgggtgacgcgaactggtgggagcacctggtgcactgccatttgtgggcatcccgtgcaccttggagcagggcggtttcccatgcggggcgacgaagcctccgggatgcttctcctcgaggagcctcctccgcacgactcctcgtcaggatatctctccaggaactccaggagcgtgccccttctcgcattccttccgctcagtccgcctgcatggcccttcgccattgcttcctccgctcttccggatgcatcagccgttcatccatatgatgcagcggagcggcgacaggaattcctgcggttatgccggaggtcctcagccatttcgcactattcatccgcattcctccaggatcatccccgctcgtgcggggagcacagcgctctggatcttgagcgatatgcaaccagaggatcatccccgctcgtgcggggagcactgcttctgctgctcaagcttttcgttcaagacgggatcatccccgctcgtgcggggagcacgaggatttcacgctcgagccgcattcggtgcggggatcatccccgctcgtgcggggagcactatatgcaccatcgccggggcgtgtctgtggcaggatcatccccgctcgtgcggggagcacatgcaggcagacctttacgacgagtacataccgggatcatccccgctcgtgcggggagcacgatgccgaagtatggtccctcgctctttgccatggatcatccccgctcgtgcggggagcaccagcaagttcgttagttagactaacgtccatcgggatcatccccgctcgtgcggggagcacctgttcagggcgtcgagcacgagcttcgcgataggatcatccccgctcgtgcggggagcacctctcccatcggcgttgatgccctgagcggacgggatcatccccgctcgtgcggggagcacgtaccatgtctgggaatcaattgtgaagcgctgggatcatccccgctcgtgcggggagcacgacgatcttgcaaggcgtgccatcaatggcgagggatcatccccgctcgtgcggggagcacccaattggcatcacctctcaggagagcatctcgggatcatccccgctcgtgcggggagcactcctcgttaagcctgcttgcgaccatcgtggggggatcatccccgctcgtgcggggagcactggcttgccgattcagacgtggctctcgaggagggatcatccccgctcgtgcggggagcactcttcgcggatatccgcgatggatgcatgcaggggatcatccccgctcgtgcggggagcactgagtccggcaatccatcggcacttgcggtcgaggatcatccccgctcgtgcggggagcacgaagatgatctcggcgcttccatggcttgccgagaatcatccccgctcgtgcggggagcacattcgctgtcgatgtatgtccgcatggtgtttaggatcatccccgctcgtgcggggagcacttgcctcctcagtctgctgggatccttcgccagggatcatccccgctcgtgcggggagcaccagatggaagaagagaagaggacgcttgccgagggatcatccccgctcgtgcggggagcaccgtcaacctcggtcttggtggcatatgtggcggggatcatccccgctcgtgcggggagcacgcgatcttctcgagcacatcgcggcacgacaggggatcatccccgctcgtgcggggagcacttgctaaagctagtctaatcttttttctctagaggatcatccccgctcgtgcggggagcactagagtgccgcatagtcgagcttgccgtcctcgggatcatccccgctcgtgcggggagcacatcctctgggagtgcacggagtgcggccatgagggatcatccccgctcgtgcggggagcacaattccatcgctaagcgttgcagggctgagccgggatcatccccgctcgtgcggggagcactgtgggcaggataggaggatcatggctgactggggatcatccccgctcgtgcggggagcactttgtccagcgcctgaagcctgcgtcctcgtacggatcatccccgctcgtgcggggagcaccccatcgtcgcggaagacgatctcggcggacaaggatcatccccgctcgtgcggggagcactccgtggtcttgttgtactccgtcacggcggggggatcatccccgctcgtgcggggagcactggagcgctgacgcaagcatgcggttcgtggcaggatcatccccgctcgtgcggggagcacgccatcgccgagatcttccagctccgaaaggtcggatcatccccgctcgtgcggggagcacatcaggacgtcgggggtgggtggctccacgtcgggatcatccccgctcgtgcggggagcacgtcgagctcgtctcgtccttgctgaggcatatgggatcatccccgctcgtgcggggagcacctggtgtagtcgcgcacgtagaagagctggttgggatcatccccgctcgtgcggggagcacctgctgtagtcgcgcaggtagaagatctggttgggatcatccccgctcgtgcggggagcacgctgtcgatgcggtggccgctagcatcaaggagggatcatccccgctcgtgcggggagcactgccgaggttggctttcgggtggagcctgtagtaggatcatccccgctcgtgcggggagcactatgaccctggcctcgacctcctgcgccttctcggatcatccccgctcgtgcggggagcacgcatccagacctcgtcggtctcgtgccgggcgaggatcatccccgctcgtgcggggagcactcatagaacctagcaccgagctcgcacgcggcaggatcatccccgctcgtgcggggagcactccggcatcccggctgacggctccaagctcacaggatcatccccgctcgtgcggggagcacggcagctccggcccggtgcctacgctcacggcagaatcatccccgctcgtgcggggagcactgcgggcctatgatcgtgcgggtgccgtctgcgggatcatccccgctcgtgcggggagcacggacaggtcgacgtgcccatcgacataccgtccggatcatccccgctcgtgcggggagcacatggtctcgggcgtgcaggccctcggctcggcaggatcatccccgctcgtgcggggagcacgtgatcgcgccggtcttctcatccacctcggtcggatcatccccgctcgtgcggggagcacaccggctcgggcagcaggcttcatgtgcagatgggatcatccccgctcgtgcggggagcaccgctcgaacgacgtgccgagtctctttggtttgggatcatccccgctcgtgcggggagcacggtccgcgatctcgaggacctgccaggaatggaggatcatccccgctcgtgcggggagcactactgcaagcgaaagcactacggagagcagtcgggatcatccccgctcgtgcggggagcactccaggcagagcgtcgccccctgtgcagccacgggatcatccccgctcgtgcggggagcacgcgaatcttccccatctgccctcgcccgagttgggatcatccccgctcgtgcggggagcactctattcctcgcgtaccgtcacgctcgacgtccggatcatccccgctcgtgcggggagcactcggtgctcgtagcggaaagcacggcgatcgtgggatcatccccgctcgtgcggggagcacaggagcccagatgctcgcagaattcaccggcaaggatcatccccgctcgtgcggggagcaccctgcgtcctcgtacctcttgatctgctcatcgggatcatccccgctcgtgcggggagcactggagcgctgccgcaagcatgcggttagtcgcaggatcatccccgctcgtgcggggagcacgtctccgatatcttccagctccgaaagatcgtaggatcatccccgctcgtgcggggagcactaataggttgtccatctgccctcgccgtccttgggatcatccccgctcgtgcggggagcactgtctctatcgccgtccagatccacctgtccccggatcatccccgctcgtgcggggagcaccatgaccgcggaagggaggtgccattgcacccaggatcatccccgctcgtgcggggagcacgacggtattccaagccagaaggtccgtaataggggatcatccccgctcgtgcggggagcaccttccagatgactacgcctacctaaagcgctggggatcatccccgctcgtgcggggagcacaagctccgcgcctacctcggctcgctctgggcgggatcatccccgctcgtgcggggagcacggggcgcgccgtggccttaggcgcaccagcggtggatcatccccgctcgtgcggggagcacatcttgtgggagtgcaccgagtgcggccacgagggatcatccccgctcgtgcggggagcaccagaaattgcggttacgaatccttaccttccagggatcatccccgctcgtgcggggagcacttcacgataagccagacggcatccggcgcgaagggatcatccccgctcgtgcggggagcaccctgcgatctaggcggccagaagatggggcaggggatcatccccgctcgtgcggggagcacgacgatcttgcgcggcgcacgctcaacggcgagggatcatccccgctcgtgcggggagcacacttaagaacctgcgtaattctagcatgactcagtcatttctattcaactatcaaggaacgtcctggcaatctgattagtgtcttatctttaccactagccagcttccctcaatgtcttcgtgccatatggtatttacttgcattgctccaagcttttggaggtgcgccaaacatccgttattgctcttactgcttgtccggtcggtctaagaggggatctgacacggtgctgctcgagatatctcctggcgtattcgtaggtgacgtttcggcacgtgtgagagtggccttgtgggaccgtgtaattagcatggtgagaaacgttcgggcaattatggcgtactcgcacaagcaacgagcagcatctcgcgtttgagacatttcagcctgactgggaaccagtggatgtggagagttgagctcatcagaaaaccatccggaacagaagatgctccgatgtccgctcctgtatcaatcccctctcgatgcgggtagcacgcgccccatcgatgcgtccttatagatgtgcgcaaatagtggatcatccccgctcgtgcggggagcaagcgcttcgcttgcggtgatgctgaacctgtgccagggatcatcccccgctcggcgggatcaacctgcactgacttcacaggggagcggtcaacgacccaggctcatccccgctcccgggcggggagtcactacagatacggggggtgggtatcttgaccgatccggttgatcatccccgcgtcgtcggggagcacccagaatttgtcgtcttcacacttcctacacataggtcatcccgctcgtggtcgggagcacgcttgacgtctgctggtgaacctgcggtcgcaagaggatcaccccggctcgtgcggggagcacataccttctggaaaatgtcgagaattcgtatggccgggatcatcccccgctcgtgcggggatcactcggccccacgcattgttctctttctctttctccatggatgcgatccgcatccccgctcgagtgctgtgagcacactacaccagtgtcgtaattctagcatgactcagtctttcctattcaattagcaaggaaccgtcctggcaagctgagtagtgtctgtatctttaccactagccatcttccctcatggtcttgcgtgccagaatgggtattttacttggattgcttaccaagcttttttggaggtgcgccac

SEQ ID NO: 739 - DNA, 313342 bp, Unknown
  Metagenome-assembled genome
tgtgcgtaagtcagcttgaatggcgttaatgtttcgacataaaatttgttaaataaccgattggcattgtatatgctaaaacaaagttgatttgctaggtcaatttctagtgtcatgcagatgcccctttcaatcgtgtgcgattgattaatagtataagcccctttcttaacaaaaacaaggggtagttcgatttttaatggcacagccacgaacttcggacaatttttaattttcaagaacaagctgcttgggtggtgtcgtcaattaggcagcgacttccgatctagtcctgagtcagcgacttaatcatgagtaaatcggtttggcgatcgtcacccatcacaaaatcgtgagcactgaattgttcaaagccccatttcgcatagaagtcctttgccggttcgttatgttcccaaacgccaagccaaactttatgcttgtgattagctttagcaatttgaatcgcttgttgcataaattgattaccgagcccttggtgttggaaagcttttcggatatagattcgttcaacttctaaagtgtctggacccattgcttctgattgtgccgcaccggtgtttaatttcaagtatcctaatgattcaccggctcgttcaacaaaataaaattgtgattcgggttccgctaattcatgggttaacttgggcaagttatatgcatcttgtaagtatgcggccatattttcagaggtgttttgtgcaccaaacgtgtccttaaaggtttcaatactgatttgttgtagtttgttcacgtcagcagtggtgagccgccgtgtcgtaatttgtgacatgatcaattcctcctatagattcctagcaaaaacagtcggtcacacaatcaacgctgtaaatgcgctgatgatgtgactgactgctttatcttaacatattatttagcctttttaccccaatcagggataatcttaccatcttcactaatggcgagaccgtcgttattttctaactcagctgcgttcggatcctcgaagtcattttcaagtgcatccacgaaacgagctgtagacttaccatctagatcatcaaagaagaagttcacaaagccgtccaatttagcttggtcaacttgtggatgttgcaactggctgatcaactcacccgtgttttccgctaaactaccaggaataaaatcaaagtagttgaagtaaaagctccgggattgcatgtaatccgctaagtccggcgcaaagaaaatcattggccggttcagtagtgcgtattcgaaacaaactgatgagtagtcagtgattaattggtcagcaacgagtaataaatcgttgatctcacgataatcagaaacatcgtaatagaagtccgaatattcatatggtaacgttggtttgttttgcacaaacggatgaatcttcagtaaaaagacgtaatcttcgtgtaatgcttcgtagattgctctaaaattcaacatttcaaatggatagtatgctgattgctggccattgccacggaacgttggggcaaagagaatgacttttttgcccttgatgaatggcaggtcatgcgctagtcgctctcgaatcgcctgtttcttaggttcatcgaaaaagatatccgtccgtggtatccccagcggctgaatcttatctggagcaatcccaaacccttccgcgtacttatccgcaatgttatgcgaagaaaccaaggctttggtgtaattacgatggttcagtgattgaatcttaggaccaccaggcatcccgagtcggctgtaaccaaacgttttaaaggcaccgaccgcatgccatacctgaatcaaatccgcattttcccggatatgcaatgggtaaactagtgggtaaaagtcatctaaaatcacataacgactagtagccaacgctttagctaacgttcgaacctctttccaggattttttggttttaatacttggcttcaaatagaatgaaatcttaaaatcagtattgcgacgttttaattcctgataaataaactcgaaattaccggagatcgtcacccggctatcggaaacaaatgaaatttgtttcttatgaatcggttgaaggcagtaccaccgataccagagttttagcgcccggcgtttaatggcacgcatcgccgcactatctaagccgacgtcttcggtaaattcattttcaagcgggttaacatcactcagtttgtatgaagtgaccttcaatgcttgtgaagctaagctatagcggaaaattaagctgtatgatttattactcttggccgaataactcgtcattttagtggtatagttcaaatcctgatgggtatcaacgatttgtccaattgaagtccgccgaattagccaaccattgcctaaatactgttgcagttgtaatttaatttcataagtaccaggtattagtggctttccatcagaaatcgttgaaaagttaacgtcaccatgataaccagaagctggaaatccgggccgttcaacagtcgtattaaccaacggaatttcaatttcttcggcctgatcgttaattagaatcaaactcttaataatccgctcggcatctttttcaggatacttttcaaaccatgctgaaccttcaataactaagtaagaactattaaaatcaagtttagtcacttgtcgtttgatcaatgattcggcattcttggcgattcgttgcgagttcataaattcaagcgcatcactttgcggcccggtcggttccgttaattcttgcgtatcgctaactggtgcccgccgtccatagacgacacgccgcgcaatccgttttaatcgttgtaacataaattatgcgctccctactaaatatttagagttgtttcatcaaaaactgaaatactcgttgtgcgttatttccatcttgatgcggaaaagtctttgctttcaaatcatggacataatcaaggtcgagcttttccaggtcatgattaataaacgtcatgattgctggagctcgatcaaaatgtggtgcacccaaatattgatagtaatcaacataaaaaccacacgtcttaatataattttgataatcaggtgtatagagtaaaattggacgttcaaagtaactgaaattaagtgataatgacgagtaatccgtaataaacaagtccattgttggcataatttgcttaacacgagtcgcatcctgaaaaacatgtacatgcgatggtaaatgccaatttggtaacttaaggtacggatgtaatgaaatataaatatcccaaggctcctgtagttgttgactggcattcacaaattcacggacataggccagaacctgtgcctcaccatgcatacctggtcggtaagtgggcgaatatagcatgcgtttattacccgagtgtgtttcagggtgctggcgcattaattcgtccatcatcggttcgccactggcaatcacgtgatcaggatcgacgtcaaaggcatccacataagcaggtttatcaatttcagaattaataaagacccaatcataattcgtatgtggtttaagcacactttgtgaagccgttggtaaacttaaaccaaaacgttttaaagacccaattgcgtgccacaattggacgacctgattattagcatgtttattaatagcatacagtggaaaaaaataatcatcaataatcagcatttcggaacgagcaataatgtgtaaagcccgtattgacgccactaaaaatccgagtttacttttaaaagtccggtcataatgataacaaaaaacgcgaatatccatctggccatctttttcgaactgggcgtgtagcgccttcaaattatcagttaactggttacttcgcatcgttgcaaaagtaacccgatgcttcctaggaccacctagaaagtaaaaaagctggtataaaagattaaagctagcgcgtaatagcgttagctttaacgtctttaaacgtcccactccatcaccgccttgccccaatagttggttaaggccccttcaaagaaatcagtgatgtcctggattgtgctgaccttgcgagtgaagcccactaagttctgcaaccgttcccgtgtaacggggctacccgtcaaaatatcaacagctcgttgaaaatcagcgcggccacttcggcttacgccacgtagtgttaagccttctgcaagcacggaacgcgtgtcaatgccaactggatcttctgagacgcccatcaaaatggccgtccccatcggtcggatatgctggatgatttgagcaattgctgattcgctcccccggccaccagtacattctagtgcttggctgacctttaaatcattcggaatatcatcaactaaataggttttgtcagcaaatgagaaataatcgagcttagactgatggcgcccaaaaatcatgagttggctgtctggaaaaatttgcttgacaagggttgcggtaataaatcctaaattaccatcgccccaaatgccaatgactttacgatcagcatccatgacgccttctaattgtgtgagcgcgtgaacaccaactgagaccatttcaataaaagcagacatttgatgatcaaagttatctggtacgacaatcgcacggtcccgatgcagactcacatactcctgcatgaagccatcataaccactggaacggaacttagaagatggtaaatagttctctttaatgatgggatctgtttcaaacggagtatttggtaccattgccactaatgttcctggcttaaatttatcttgaggatccttgacgacttcaccaacgccttcgtgaatgagcgccattggtaatttctgccgtaaggtcgcttgtggtcgttgacccgtaaagtaacgagtatccgcatgacaaacggataaaaagcgtggccgcacaataatatcattattggtgatctcttcagcaacagtttgcacttcaaactgacgaggatctactaagcgataaacttgatttaacatattagtccctcgtttctactaaagcagaagcaactcttaaatcgtaaggcgttgtaatcttgaaattatagttttcgccccgcactaaggtcacttcttgacctgctaacaagcaaatcttgcaagaatctgacaaagtttccttttgggcatcagttaaggcgttgtaagattcaactagtgttttgatattaaaactttgtggtgtttgcccctgatacatagttgaacgcactgggatatcgtcgattttgccttctgttccttgcacaatcgtatcaatagctggcaccaccgtatcaactgctgggtgctctaaagccgcttcaatattatcattgatgatacgttgcgtgataaaaggccgtacggcatcgtgagtcacgacgatgtcatcatcgtggctaccataattttcttggatatagtcgatacctttcatcaaagtttcgttacgttcagagccaccggtaaccacgtgaactcgttcgtctgagatgtattttttgattagatcctgtgtgtgactcaaccagtcggcagggcaaacaactaaaatcgcatcaaagcgactttccagtacaaacttttcaacggtatgaattaaaattggcttgcctgctaaggtcaaaaactgtttaggcatcgggacgttccccatgcgagtacccttaccgccagctaaaatctgagcataaatcatatcaacattactccattcatggtacatattattaaacaattataaacgagaattatggattttttatgaacttgtccttattaagtcaaacactagcaagacaagaatagtatgatacataattcgctattcctaaaataaaacatggctacgttaagaaaaagcctacaaatatagtacgttcactaccataacatatctaatttaatacaagtactaccctgtcgacaagaggcaaataataaagaattattaattttttgccgaattgcagtatacataacgacacagcgatggtgctactcgaagatatgtggtgtattttagacttaaatctagtttggtatagtaatttttagcataaaggttactactattatgaactgttcttgacggttattcaattgataacggtttttggattgttttgtggtgtttagatattaagttaaagtaacgtgttacataattatattatttgcaactcatcaggctatttatattctaacgatgttacggccgacatatccttttgtcagcattagctctaattaattggtatactaggcctagaaaaactaacgaaatggttgtgattatctttgactcgtctacgaaactctgggttggacttctctgtcgcgacgcttaacttcttggctaacgtcggtattgtcctaccctacgttctaattctctttaagtatcagcagacccacaacgcgaattacttagctgcgatcgtggtcttctacgtggcccgggcggcgagcgtctttgggactaagcacctaaacctcaaggctagtagttatttgctcatttgcctctggctgggtgcgtttggtagcttgttgttcagtttgacggctaacatcgtggccgtgctggctggggccctattcttaggatatacatccgccaacatctggccctattacttgacgatcaagttacacttgtccgcgcagacggattttaagttaaagaaaatttactggttgattttcttagttctcggcattctctttgtgctagattttgcgctgaactggggttaccggcttgcctttatcctactggcgctactatttatcattgcgttgcctgctggccgtttgctgagtcagttttcgctcgcattttacgatcaacatgaaatggcccaagtacgtcccgtcaagccgtggcgcgttgtggtttttatcgtcttctttgctgcgattggtttactgacgttgcttcgtaaggcgagcctacaaatcgcactaccggccgtattaggaattatcgtcgtggccattgttctactaaatctagaactagctgctgattggcaagccatgccggctaacaaactacggatcgttgatcggggctttttactgagttttgtcctactgtttaatagtttcttcggtgtctttgtctttggcaaaatggggatgtacctggtcttcgccatctatttgttgggctttgagaccggccggccactatatttattattgggacagcatgacttacatcgtgccaccacgattgcacgcggtggcctgattgtcggccatttgttagttgccacggcccaacccgttttatacgttgccggtttgctcctgatctcattgtacgtcggttttgaaaacccagccattaatactagcgtttatgccactgaggttgatgatccagatctcgcaattattcataaatatcgcttttccacttatgggggcctgctttgtcaactgtgtttcttcggcctcttagtaattgttagcagttttcgacaattaaacttgctcaatttcttcaatccagcttcaaccgctttgaagaacacttatctagtcgggatggtttggcccttaacggcgatttctctgattgttacgctggtcacgctctacggtcagtattatttcaaacgagcacagtcaaacgactaggcaccatctaaggaggctttacgaccatgatttttattgcaagtgctgcaatcatcctgccactgattcttctcgggggactgaatttatccgcgacccgcggaatgaccattagcgctctggtggtgattattaccggctactttttctggcagattagtccaacggtcctcaccgcctcaattttacaggcgattcataaagccctccccatcttatggatcttatttggcgccttactcatgctcaactgtttgcgtgccactggtgcaatcgaccggattaaccagggctttcaaagtttgtctgctgacatgcggctacaaaccgttttggtagccttcctatttgggggcttgattgaaggtgtctcgggcttcgggaccccagcgatggtcactgcaccattactaattgcactcggcttttcacccatggcggccgttatcttggccttagtggctgactcgacccccgcagcgttcggcgccgttggaacaccattgaccgtaggactgagtaatgtgaccgaaaaagcatccgtcttgaacttgattggcctgcgcatcacgcaactcgatttattcgttggtgcgctaatgccagcggtgctcattttaattctcatcatgtggtttggccctaaggcacaccgcttgaaaagctggctttccgtcttaccttgggcgttagtgatcggtttcgtttacagtctactggcactcctcagtgcttggctagtgggttatgaatttgtttcaatcatcgcaccgctgggaacgctggttattgccatcatcacgatccgattgcactggttgttaccaaagtcgagccagttgacgccatggcggacgaacgggatggcagcccagacgcctgcgcctagtccgatgaacctgatgaccgcttggtttccttacctgctggtcgttgtgctattactcgctagtcgggtcgtgacaccgatcaagcaggttttgacccgttatgctaacttatcgtggtcccacattctaggttatagtcaaatcaactctgattgggaactcctctattcgccagggacaatcttggcggtagcggccatcattgggttactagtacaagcccgttcattaaaacccttactaccaactgcccattcggtcatccgttcgatgggcaacaccgcaattgccctcggtgttaccctgatcatggttcaagtcttcactaattctggcttgaatcaggccaacctacctagcatgccaatgtatatcgccaagtttatcgcgacctatctagctggtgtttgggtcatcatggcaccattcctaggccaattaggggcgttcgtaactggtagtaccacggtctcgacactgacttttgcgcaaattcaagctgatattgcggccaatgcgagtttgaagcccacgattatcttggcagcccagctcgtcggtgcggcagccggcaatatggtctgtgtccataatatcgttgctgtcagctcagtcgttggcctgagtggtcaagaaggcgccatcttacgtaaaacactactaccaggtctgggttacgccctgttaattggcgttgccgggtggctactattacgtctagtagcttaactgaatgcgtataaaggcactaatcaccttaactgcggttgattagtgcctttatttcatgaatggattagactaaaataggattataattttcaacgcaaaggaggcaccgacatgcaagtgcgcttagtgccaaacttacaactcggtgaacggattatcgggccgacccccgaccctgaggccaatcgcgcgctttatcaacgttatgcgaaacgattacaggcgcggctaggtatcggctttcaagtctacctagatatgagtgacggttatgatttactgcatgcgcgtgattacgacacagatacttgttgggtggttgcagcggctgtttaccaagcattaactgattctgccgtgatcacccaccaccgtatcatctcgctgagtgaccaagcacttatcttaaaagcgacgcagcccatcgaacaacaactgcgccaatctccgactgatcaatagtcgcgattcaccagctggcagtcgaatgagatgaaaataacgcctaaccaacaaaagtagcagtgtactagccatctctggctgattacgctgctacttttgtttatcagctcactgcttaatttaacgagcgtagaaactagttattgattattgcatactggcagccattttgatagccgttgccatctcttgagccttgacttgataaaccactttaccagcttgccattggataacttggtctaaaggtccagagcctgacgaaatcgcgtcaaaagtgatggcgccgaccgactgtggtgctggtaagtagacctgctcgaaagtagcgacggcctgtttagctaacgcgacgcccgcatcttcgtgcatcatgttcgcatgcacggtcaacgaccagcggccctcattccacatgatatatcgttgaccagcacccgcgtcgatatgcgcggtgatttgatgaccgagatcgacggttggcagccctgctgtggatttattatcacgataacccacctgctgggccgcggcattagttgtcgcataggtcgtcttagtgacagtcgcataagccgtttcatccaccacggccgccgcgttgaatggctgggcctgttgtcccacactataattgatggtgtaattggctgcgtcacctgaatagcgcatgttcaacttcgaactgccactagttaacccatcgacttgtggaacgagcgcctgctttcccaacgtcttagtcaattgttgattcaatgctgccagccgggtcgtagccgtgggctgggtgaccgacttgttagcggcgctggcggcccgctcacgcgctgttctagacgagcgcgtggctgcggtttgaggccgactactagtactactggtagccttagccttcttttgggtgctgctaaccgttgccttggcactcgtggtcgtctgactagttgacttggaatcctggtgtgttggtgatgaacagccgaccaacaagacggcaagtggtaatacgagcaagttgcgataattcatactgttcccctccccaataatcatgtcacggctgatacgtggtcgtcagcaacgtccatgatgtttgacttaattatagaatagaatgcactattaggggtgattattgcaccttacaaaaatcgccggccattagctggtaaactaattgggtttaccaagactgatgaccggtgattacaattatcgtttttaaacggtgcgatgcatacttcgttcgatgactaataaaatgacgaaccaaacgactgaaccgatgactgcccaacggttgacttgatcaaagcacaagacgaccgtcaccgcgataaagaaggccaaggtcgcgatgttggaaacagggaacaggggcagcttaaacggattatgcgtactgtcagtggttcgtttgtaaacgtaatggcacaccaacaaggcacaccaaacaatgatgaagttggttgttgccacgttagagatcaacgtgaagacggtacttggaatcacgtaattcaacgccacgatcaccagtaagatcaatgatgagaataacaatgagcgggcgggaacgttgtaacgattgacctttcccatccatttcggcgcgttgtcaccgtgcgcaagtgtaaatagtgttcgactcgtactgaagatggcactattacaagccgagagcgccgcggtcagaaccacgaagttgataatgctggccgcggctttgatcccaacgtcgctgaaaacttgcacaaagggtgactgactggtcgtgatctgattccaaggataaattgccatgatcacgaacaaagcgcccacgtagaagaatgagattcgaatgggtaagctattgatggcccgtggtaattctttttctgggttttcggcttccccagctgtaattccgaccatttcgatgcccgtaaacgcaaagataacgagcgaaaacgacatcaagaagccctggacgcctgttgggaagaagcccccgtgactgaccaaatttgtcaccgagaccgtttgcccaccgacatgggccgatgaaccaatcaagatagcccccgtcacgatcaaagcaatgatagccaccactttaatcattgaaaaccaatattctaattcgccaaacgcactgacggagagcatattgaatactaataaaatcaaaataattattaagggtgtcacccactgcgggatccacggaaaccagtaacgaatgtagataccactcgcagtcaagtcagccatagctaaactgatccagcagagccaataggtccacccaatggcaaactcgaaacgtttacctaaatatcgattaatgaattctagaaacgaatgtaaacgcgtatccgacaataatagctcgcccagtgctcgcatcatcaagtaacagaagaaaccgccaatggcataagccaacaagatcgacggccccgcctgtttgattgctgaaccggagcctaaaaagagcccggttccaatcgcgccaccaagcgcaatcatctgcacgtgacggcgttttagtttacgggcaagttgctgattttccatatgacctcaactttcctttaatccaatttgataataattttcataaaaatacagattttttcacgtccattcattttatgataaaataatctgccgtgcaacttttgccaccgaaggaaaccgtaaaaaacgggttttaattgccatgcaggattttttctggtatctttaattactttgattattactggaataccagtcattagagctaaaggagtttacttatgccaactaaaacaactgatactttctggaaacgattcttcaagggcgtcgtcatcgccctcggttttattttaccgggcgtctcaggtggggttctcgccgccattctcggtatttacgagcgactgttgggctttatggcccacttccgtcgtaactttaaacgggacttctggtactttgtccccgtcggattaggaggcatcgtcgggattgccctgctttccgccccgctggaatacttacttgcacacgctcaggtgatcgttctctgggggttcgcaggggccatcatcgggaccttaccagccctgatgaaaactgcaactagtcgggcgccacgtgactggctcgacggagtttggttcttcgggaccttcattattagtgccggcctactttactttatgagtgagctgtttgggaccttgcccgctaactttggtggtttcatcgttgcgggagcgctgattgccttgggcgtcttagtgccgggactgagtccttccaacttgctacttattttaggccttttcacacccatgctgacgggctttaaaagactagatatcgtaggcgtctacttaccgatcgccatcggtggcatcctggcgatggcgttgttctcgaagttgatggatcacctattagtgaagtttcattcccgagtctaccatttcatattaggtattgttctggctagtaccatgctgatattgattccgaatccatatgcggctgagagtatctcatatgcgcatgccacactcagtacctacctattcagcgccatagctcttgctgtgggaatcgcgctggggtactggatgagtgctttagaaagtaaatataaatagtgccactgaccgttggcaatcttgacgagtgccgttgaatgccgttgtgcggtcacggttaaccaaaaaactgagcgtcggaatgtgaaaattccaggcgctcagtttttttggttaactactcaatcagccaccttaactttgattgcgacgtcgccgcggttgcaatcgtcgtaattcattgacttgtgcttgaatctcacctaacatttgtgtttgcattttctggatttcaagcatgtttggttcatcttgttgaattaaatgatcgactttcgagtgcaggacccgaatctcctcttcagacatcgagttcactttaaaatcattggccgcttgtagccgatcatactcagctgcccgattctgactcatcatgatcaatggtgcctggattgctgcgaccatgcttaaaaataaatttaataaaataaagggataagggtcaaaatgatggctaaaaattggtaagacgttgagcaacatccacacgagcatcaccacgacaaacgaaatgataaacgcccagctccccccgaaccgtgcgaccccatccgcgacccgttgaccaaatgtcaatgaactttccagctcgctattaacatcgacgacccgatacgtgtggttagcgagaatcttagataattgcgcattgaccttatcattttgttgataatcgttctcgatcatcgcatccatctttgctaagcgataatgtacgagatgctcactacaaatgaaactgctattatgggcctgcggaaaatcttttaaaatcatttgccgcaaactagtttccaattcttctaatcgcataccgtccacaacttggtaacgttgttgatcgacaatgcacgctgctgttttcgccattagacacacacctttctctgatcccggtgtgagaattacgtgaacaacgcggcctccttgattagcaaccggaacctgacatcgcaaaaccacacctcacaccatctatttaattatacaaatttaaggcgcatctgcccagttaaagaccaccaatcaaaaagcgattattcgccgacctgaagtgacgagtttcctcgtattcagctcattgaataatcgctgcgttcagacggagagttcgtccatcaacatcatggtctgatactgaccatcgtctaagactgccaccgtctcgggaaactcccgttggtaattgactggtaaatcgaattccatgatggcatcgtgctgcgcatcaaaggccacggtgacttgcccattacgtgcgatcagggcaaattgcaggacccgtggcaggcgaacgactccctttagattttgatcaataatatcccaaatgccatcaatcaccgcgctcggtagcttggcggctaaccctagcgttgcaaaccgttcttcatcttgatcaaacatgctaatcacctcattactcaattcggcttagttatcacgaacaatcactgcgacctctttttcaatccggataaataagccttgtgaatcctgtcgaaaatcattttctaacgtggcagacagcggtttaatgcggccaacgacggtgccagttgtcccatagagttcgatagtctgaccatctgcagcccacttaactgtccagtaactaccttctaaggcctcatcgacgaagtactgagttcccgccagcacagcttcattaatcacgctactttcatccgcagtcattcccgcgtctaattcccacttaagtttttgattaacttccaacatgtctcctggaatcaaattttgcatgattattcctccacttttgttcatttacttaacatcataccacaatcacaactaatatcaggcattcaaacttatcggtaccagttgtcagtcagaaattgatatggtattgttatgataagaaaatgagattattagaaagtggtgaatgacgtgttggctaaatttttagcttggattaaccttaagcgcacaatttttgcagttatggttatgtcaggggcgcagtctgcgctttttccaagttgaatgaccactagccattgcgcagtcacgagcagctgacgacaatgggtcgtctttttttgtccgctcgtggccgctaaaggagtccaacatgttatcaccacttacccgtcgtaacctaaccctcagttatggttatgcggcctgtgctttttttggtatcaacaccctctgggtgatctttttacagcaacaaggcctatcactcgttgagatagggctatgcgaaagtgtttttcatctgactagttttctctcggaagttccctccggcgttatcgccgaccgctttggttatcggcctgtcctgatcattagccgcctgatggctatcggacacgccctcatcatgttgacggctcacagtctcggctggttgctcctagcattcatcctacaagcctgggcgtataatctccagtctggtacgattgaagcggcacaatatgacagtctcgtcaatactcaggccacgcaacattatccacgcgtcacgacgattctcaacacgacaatcgaagtggccgatacgttgggtgtcgtgttggctggctggttaatgccccagcatctttcagtgacgtactgggtctatttagcggcagctctcattgccattctggcaatcagtgggctgcacgttccccagcgccagttgaccaagactcattcaacacaaccgtcgttacgaacgatccttcgtgctgccgcgcatctgttagtgacccaacgtcgtttacggcttttaatgatctttgacgcgctcttttcggcactcggaacaacttattactattactttcaaacagtgatgactgctcagcactttagtgggagactaatcacgacgatcctcattgcgagtatggccctcaatattgtggcgatccaactgacaccttggctacagcgacatcaaacccaacatcagttactttacgggctctgcctaagcatgattatggccctacttagcgcatttagtcacgccatcggtctactggtcctcatctatttagtcatcaatagtttgatggcactgattgagccactgttttccaactactacaatcagctgattccaaacgggcaacgggccaccctactgagcgttgccagcatggtctttagtttagcgatgatcagcgcttttcctctgattggctggttaattcaacgggtggggtttgccgttactttcggtagctgtggcctgctgacattgatcgccttgctgagtctttacggctatgcccggcgaagggccgtccagcattgaaaaccataactaatcactgacattactgctgagagatgttcctccacgacttgaccggttgtttttgaccaccccgcaaccagatactaatcgcaattgtgtcaccattaatcatgcacgtgaacggtaaagtgaaggcccccgagaatcgaaaggattcctgggggccttttccgtcgtttggggctgttcggcctattagctagtttgagtgagccagattcgatcgttcaaactgttgccgaatttcctcagcgatggcgcgcattcgctttggcgtatctgcttgtgccagccgatagccgatatagtatggtgagacattaaatagtgggaccactttggcaacaatctggtcatcccgcggatagaaaaataggttataactatcacactgcccatgaaaatacgtatttagcgtatactggacgacctgttgcacagcatcggctaacggtgcaatcgcggtagctggagcagcaacgttgatttcgacaaatcccatgataggccgatcagaaacagtcacttggacctgatcgaccgccaacactgaatacccagtcaaattggctgctgtcacgttagcgtaaccatcggcggccattaaaccaacgatttgcatgtgtggatgccgtaaacttccacccgagtgtgggccaaaacttttatagcacaacaccgatttgaaccgaccactcgcaattgtggcttgccagtgcttcagagcaaacgcgaagacagcgcggttttgtgcggatgagtaagtagcaatatcgccatcatggcgggccgcctcgatcacgatcgtttgccaggtagcttgcaaggtcggaaatttattcaacagccagatacgatctgcatcttgcgcgataatatcagtcaactggcccggatcgcaaaaaggacaggcattgtgcgggtgccggatattttctggcttatccttcgcaatggccgtatcaaagattagtggctggtttggcaaggtttctcaacttctttcatgaaataagaaaacgggtccgaaacaccaattaggtgccgacccgtttaccttttatacgcattagttcattggttccggtgtatcagcgcccggaccaaactggacatccgccatcgtgatccaaacaacaaattccgttgaagccaaccgccagtactgcggatccgacgcgggcgggagtgattgttcaaagagcgcaatagccaacgcgttcgccgcattgtccgcagcaacttggacactcgccccaaaggtctgggcggcaggaacgtctggaaaacggacatcccagtaggtgccttcatcacgaaaaatggctggatacttaacttccacataattgtgattcaattttatcactcacttcttacaatcattttaaggctattataccgaaaacggtcgcaaaagcccagctcaaacatcatgattgcaattaaaattaatcagcttttgacacgtggtacgagccattactatccgtcgtgaccttatagttcccactgatcgagttttcaccatagtccttcgcgtcatctaaattatcgtatgtcgagccggagtgactgctactgctgctcttctcagtactcgttgatgacgtctcactcttagatgagctgctagctgttgaagtactgtgagaggtggcactactggtggtcgtttgatgactggccgtcgtgctatgcgaactagctgtcgtattgccagcggtcgtattagtggcagttgaactgctatacgcacccgtcgtttctgtcccatctgtgctagtgtcggcatccatacttgcagccgtcgtttcgctagtactttcactacttgagcttgaatgcttcttctttttcttcgatgagctagatgatttcttcgaagatgattttttgcgcgccttgctgctacttgaggaactcgtggtttcgactaagtcttggttgctagctgctttgacaaagtaaacgactgttccaccgagcgcaatcacgattaaagccaatagccataacgaaacgtgatgttttttttgcggtgacttaggtgcttgcggtttctttggatcgttcggttccttaggtgcatgggatccctgtgaactcgccttacgtccccgcttgccacccgtagcctctcgcgctttcaagcgtgacatgcgcgtctgtttttgttcaggcattaactatcgcacttcctttcttgcttccgccagtttaccatattttggcgggcttgtcttaatgcttaataaaagaaacaatattatttgtgtcgatttttaatatcgacgttcattaattaattgcttgtaaattatcataatagttggcaagtacaccataaatatatggtaccaaccataactggccgattccagccgttaagatactgagaagttcccagcccaaaaagcttaaatgcaacacgaataactgccacttgtgcccgtgcatcaactgccggctacgggtgaccgcatcacgatagcgtggccgtgcttgaccagcaggtgttgcagctaacaagtccttatacgcataaaaagtctgtgaataagcgtacgccttaataatacccggaaccaccaatagcaggctccataggaagataagcacagttttataaataatcagaccgaccagtgcccacccataacgtttcgtgaacccgaccgttgagtcactgaccggatggatctggcgttctggttgtcggacccagtccaacatcgcataactcgtcccaatccgaaagatttgaacgaccagccagacaccaacttgaaccagtaaaaacccagctattacagctaaaatcaacgatatatcagaaccagtcagggtccccaactgcttaaaagccgtgtcgtcagtcgtggaactgcccgacgacacgcgatctgaataattggccatcaccccgaaaatcgttaataagctaataataatacataataagatggcatctttccaacgccccttaaagagttgcttaatttcggttttaagttcggccctcgttttttgaatcattgcgccactcctccactacttgtttaatttagtccattttccgttttttgtccccgttagtcaacggcaaaaccctaaaaaagcgctggcaaaatgccaacgctacgagttgaatcataataattgcttatgcataatcacaacgggggccccatcttcatcatacgggccggccgtaactcgataaccacacagttcgtaaaagcgctgggcagtgagttcaccatgaatctcgccatgagtaaaaccacgttgcgtggcccactcctcagccgctgtcaataattgacgaccccaaccatgaccgcgataggccttccgagtgcagactcgaccaaatcgcatcacgtggtcagcttgtggttctaagcgtaacgttgtaattggtaaatcaggctgtaaatatagaacagcgtattcacgctgatcagtatccttgacgtcaaattcaacgtcagcactgattccacgctcttcaacaaatacagcctgacgtaacgcgtaggccgctgcccgattggctggtgatgctgaaaaaataattttcattttagtaggccttatcaatgtccttcaaccaggctaacgctaatgacttgtcacctaaatgggccccaatcactggaccaaagtacgtgatatcgatcggcatgtctggataaatttgttgtaacttttgtttccaatcttcagcggcagccaaattattcccctgaacgataattgctcgcagcggatagtcgacttttgactgtgcttcagcaaagaggtgctcaactcgcgctaaagctttcttagttgagcgaactttctcaaaggcgacgatttcatggctctgatcatcaaaagtcaacagtggcttgatccgtaacacgcttccaatgaaggctgacgcattcgataaccgaccaccccggaccagattttgcaaatcatccacgataaagtattcgcccatcgaggcccgcagatcatctaggcgtgccaggatttcttcaacactgtgaccagctttagccatccgcgcggcttcaattgccaaatagcccatcagacggaccgtaatctgggagtcatacggataaagtttgatattatcgaccatatctcgcatgttcatcaagctattataaaaaccggaaatcgtgctagcaagatgaatactgatgactgcatcataaccttgttctcccaagcggttatagaatgccaccatttcccccacgggtggttgggacgtacttgggaacgacttaaatgatttcatatttgcgtaaaagtcggccgttttaatgtcgacaccttcttgatacacttttccatctataataaccggaatcggcacgacatgaatatcgttgtccgcgacctcttgcggtgtcaaatagctcgtgctgtcagtaacaacagcaatcttcatgacttacacctacttctcatttaaataataacaaatatcatagcataaaactaagttatactctaccttcgaccgtttggaaagtcatggctcgagaattcggctaactgacttgtttaaccgattgagcagaatccggagaaggttttgttcatcttgtggccatttgtcaaaaacttctgcttcaaactgttgataatccgcattaatcttggtcaatgccgctgttcctgccggcgtgaccgtgtaaacgagttggcggcggtcacgaccaatcgcttccttactcaaacgttctttcttgactaggctagccagttgccgacttaatgtagatgtatcaagctgcatagctgtcgccaatttttcttgcgtattggcccccgccgccaattggatcagtagttgccattccgcaacggtgattccttgggccttagtaatttttttcaacatggcagtttgcaacttagcggtttccgctaaggccgttaaacttgacttcatgacagttcattcctctcaacaataattcacatcggtccattgtgacttgatttaccccgcctgatgattaaaaacgtcccaatttttagaagcaaaaagactcaactgagcttagctgacgcaagcacgtttcagcgtaaactggctgatccagtgtgattccatcgtaattagcacgctttaaccatcacttatgcgaatagcagcacacacaatgaatacatttgtattatacaatatagagtgtgtaattacgactactttttatttaaaataccgttaaagtagtttttgcatataacatttttagattcaaagcggtcatccgctaattgcttgtttgacaactagcagcggtggcaactaactttatgcgtcagcgcggggcgctaacttgtttttaaccgttcaaaaacggtatactagtacccggttaactgtatttttacagtgataacgaatatcttagaaagcgagtgatcacatgtcctttgatggtttatttacccatgccatggtcaccgaattacgccaaacactagttggcggtcgtatttcaaaaattaatcagccataccaaaacgagttgattctgaccattcgtgccaaccggaagaatcacccagttctactatcggctgacccgacgtacccgcggattcagacaacacaaatcccttacgttaatccggccgtgccgacgaacttcgcaatgatgatgcgtaaatatttacaaggtgccatcgtgaccgatgtgtcgcaggtcgccaacgaccgggttgtgcacctgaccgtgacgacccgtaacgaactcggtgatgccgagacattgacgttgattatcgaaatcatggcgcgacatagtaacgtgatcctagttgataatcagactggtaagatcattgacgtcatcaagcatgtcggtgcggatcagaatcgctaccgattacttctaccaggcgcgacctacatcgagccccccaagcaagacaaacaagacccatttacaccgaatactgattttcacaccttagtcacggattaccccaacgaagacgtgttggcaaaacaattgcagcagcattatcaaggattcggccgtgatagcgcgcaacagttagctgccgacttgcatcagcctggcgaccttgatcaccattatctggcctttttggcacagtttgatcagccgcaggcgacgttgatcaccttaccaaatcataagaccatgtttgccgcgggaccgtttgaccattttggcaaagccacgcgccaattcgactcgttgagcagtctgcttgatttttattatgcagacgcggcccaacgggaacgggttcaacaacaagctggtaatctaattcgggtggtcaaaaataatctgaagaagaatcgtaataagctcaaaaagttagaaaagaccttagctaacaccaagcaggccgatgagctgcggttaaaaggtgaaatcctaacgacctatctacatgaagtcaaacgtgggatgactgagattactttaccagactattatcacgataacgcgccgttaaagattcaactatctaatcagctctcgccttcccggaacgcgcagaagtatttttcacgttatcagaagcaaaaaaatgccgttggcttcgttggtgagcagatcagcttgacccaagctgaaattgattatctggacaatatccagacccaaatcgagcttgctagtcccgctgacatcaccgaaattcgtgaagaattgacgcaacaaggctacttaaagcaacacaagactaagaaaaagcaacgcagttcacgtaaaccgagtcaaccccaggaatttactgcgagtgacgggacgccgatctttgtcggtaaaaacaaccggcaaaacgatcagttaacattgaaaacggcccgtaagagtgactattggctgcatacacaaaaaatcccaggctcacacgtcatcattcattcagatgatcctagtgaccaaacgctcacagaagccgcgaatctcgccgcatacttctcaaaagcccgcgattcagcaaccgttccggtcgattacgtccaagttcgccgaattcgcaagcccaatggcgccaaacctggctttgtgatctatgaaggtcagaaaacattgtacgtttctcccaatgctgagcttgttgaacaactgacaccgcacgcgtaaactggttttaagagtacgcagtgatcaatcattaaccaacaaaatcgcgcgtccaagataaaatttctggacgcgcgatttttagtacttactggcagtgcttcaaacggtaacggttcaaacttcccgccgccgaaagaatagcaggcctaacactaagaataaaataatgtatgcaagattgccccaaaacaactggacatccgtgagcttggtaattttactcagcgtcggtaatcccaactgggctgaaaagttgaacatgttgagtgggttccatttgagccacgtatacttccgaatgagtgcgatcatgggaatattaaccattcccagaacaaagtatccgatgattccgaccgcgactgccgcaccagaactcttgaaaagagcagcaattagcagcactagacttagcagtaaccacgtattgagaaattcaccaccaaccaattgcgcttgggcgtcgggcccgtccgcaaacaaacgcaagttgtcccaaccgctcatatacggataaagactcggatactcgattagtgaccccaccgtcgccaagatgggatgatgatcgaattgcatcgattcacctgcgatttgaatctcaccatccgtgctaagtagccctaaaattgctttcataattgtcgtttttccagcgccattcgcgcccaccaggcccacgatccgtccctgggtgcattcaaaactaacgtcacgcaaaactggctggtggccgtaacttttattcagatgtttaacggttaaaattgcatcggccatttaaatcccctctctttcaagatggcaaacgttctcataagctgtcgacacgttgcgtccctccttaaacgataagtaaccctgcctaggaaagatcaccattcagacgttactgaattatagctcgctattcatttaaatgttggttttctcgggcgcacaccagtattttggtacttttaacccccaccacgcgaaacgacgattaactaaccaatcaacgtcgtcatttttgtcacattaggactaagccacacgcccgcttaaacgcattagttgtgcgcatgaatcaaaaataggtgaccactagatcagccacattgccaacctagtgttcacctatttttcgcttttgaaatgaaatttttggcgccattccgggattagctcaggtcaataaaccggatgatccagcacggtccagtccgggtaggtctgatcgcttgggtcaaaccgcccggataacaacactgcctttgcttttaaaaccaacggtgacgcattagcttcagtcaacgcatgcaacggcacccgtgatgctccatgcgaatcttgaccatcaaagttagcgacatgttcagccagttgcccagttgtccgggtcactcggtaaaagaccgccagatgttggttcatccgccactgcttgaactgccagggataccgaaaactcgtgatacccaattgcgtcaattcagtcgggattaacccggtttcttcttgaatctcacggcgaatcgcggcaagtaagggctcaccatcggccaaactgccacctggtaagtcgtagcgattcgtatagggaccaccaaactttttagtaacgaccaacgcatgctcatcgccaataatcccataaacaccaaatgcacggtgataagtttccattgtcccacgtcctttcacgtttaaacagcgttgttaagcgtaagcgctagctatcttggtgtcaaggcaaacctaagcgtttactgtaacggtaaacatatcagatgattgtaagtttactattttagtaaacattaattcatcgattgtgtttacaaatacagtaaacagtcttataatcagtaacattggaggtagcctcatggacttaactagtttaacgattgatgatttaaaacgcggctggcatcaaacagccactgcccggtattgtaattactgtgatgctagttgggaaacgactgcagcggcggccacgatcgaacaacacttaacgatcgtccatggtggtatccagtcaccactgattcacttagcgagtcgctacaatactttaaccactaaacagcaaaatttactgactgcttttgcgactggcatcaaggatgccgacttggctaaacaatttcaattagcggcggccacgattcgacatcaaaaatttacatttcgtgaaaaagccaaacaagctaaattgtacctggccatctatcaatccgtctttgagagtggtcagacgcctaatgatttgattgtcctgccagaacaacccggaattattgatgaccgctttgcgattactgaagacgaagttacccaaacattgaagcagtacttcaactttgatcatgacccactacaattgaagcggtggcccaaaaagcaaaagacgattgtcaccattctaacgcggattattgatgaaattccgatgaaccgaccaatcaatgaagacgagctcaaccactatttacgaccgatttattttgactacaccacgctgcgccgttacctgatcgactacggcttcttaaagcgtaccgtcgatggccggcaatactggcgcacaactactaaggaggactgaaccatgcaaccagtcgaaaaacatcgcttacagcaaaaatacaaacttgccccaacttattacggcgtcattcaaattaccaacgaacgcaatcataaaatttggattgacacagtgcccaatttacacaaccgctgggccttttatcaactaaatctcaataaaaacttttaccggtccaacccattacaggctgattggaatcaacaaactgccgctgacttttcatatcaaattctgtggcaaaaggaaacgaccgatgtcactaatatgcgtgccacgctcaaagcactcaaaaccaaatggctgcacgatttacaaccattcgatgaccatggctataatcagcgccctaaagattggaaggaaaactaaatgaccaccactaaaccaaacatgcacgccgttgctattaatcctgcggcctggccgcgccaaacttatttttactatttcaccaagatagcccccagcggttttagtctcacggtaaatatggatattaccgccaccctagcttggactaaagcccaccacgttaaattcaacgcggtatatctatacctagtgagtcgcttgttgaccacacatcccgaaatgcgcatcggctatttgaacgatcaactggtgacctttgacgtgttacatccatcttatacgatcttacacgctgaccggacaatggccaatttatggacgacttacgacaccgattttgaaacgttctatcaacactatttagcagaccaagctgaatttagtgcacttccagggcccatgtcgaaaacaccacaaacacctaatctggttaatatcggctgtcttccaggagtccactttagtagctacacgcccctcccattcaaaccactagatagtttctttccaatttttcaggcgggccagtttaagaaggacgctgacaaaacaatcatgccgctaagcattacggtcaatcatgccaccattgatggcgatcatctcagtcatttttttaatgaactccagtcatgttgggaacaaccaacacaatacttagcctaaccatatagtcgaggcccgttatgcgcatttgttatccagcttaaacaccgctcgtcaggtctttttttgaagcgaatgagccactagcttaatcagtgttatttaccggtgcttgttcgctcatcagattatgcctttcttcaagcaaccacaccgtaaccactgtccaagtagtgccggccctcgccagtacaattctaagaaattcttatgctagccttatgaaaacgcagtagttgagtctgcttcaaatgggtaaactaaagatattaattaagaaaggaactgatgtctatgcgtcattcacaagtcttaacgatcacagtgaaacaaccgcggcctcggagtgctgatccagctgtcatttatagagtcgatcgccatccttactggcattggaacctaatgaactaataaaaacgaaccgtgcactgaatcgtagtgggctcaaatgcgcggtattaaaaataatcccgttcgatcagccgtgtgggccacctgattgaacgggattatttttggttgcaagctctgcgggtatccggtacactgaagccatcaatgaatggaggaatgccaatggctgagtaccttgacgctgacctagctgttttgacaccatatctggaaaagctgggtgcaacaccccatcgcgcccaactgattaccttgctcaactgggtacacacgacttttccacaactcaaggcacgggtcgcctggaatcaaccgatgtttactgaccacaacacatttatcattgggttcagtaccgccaaggatcatctgaacattgcacttgaatcacatactttggatagctatcggaacgcgatcacggctgctggtgataaaacaaccaagatgttatggcaagttgctttcgatgcgccaatcaatcacaagctacttgcagaaatcattcaatataatatgactactaaacaaaccatgacgaccttttggcgcccttgatgcgtcagcgttcacgacctcgctttcatgcctgaatccgagtcgtgagcgctttttaatgcttaaactcagactgattgtcaacgcacttaaatctagttgacataattttaatttttatcagttgcagccaaattaatgattttttcaaatgtgaagcggcccgcgtcatactggtacttgatgactgcacagttatgtaacacgatgccttgccactcaatttcgtccattgaaagccattgccgcaaaaacatgaagctagccccaccgtgactgaccgccaacacctgatgatgatccggacgtgccatcaccgccgtcaacgttttgacaacgcggtcttgtacctgcaaatcactttcgccaccgtactgacagaaaaagtcaccatgactgcggcgcacggggtccggttttggatttaacacttccgactcaccttcgaaaacgccaaaattccactctttgataccctttaaacgctcataaggttgcttggtcactaattctaacgtgtcactagctcgttcctgcgttgagctgtacgcatgatcaaacgtaatcccttgcgcctgaaaatacgcacccacgcgttgggcatccgcaattcctttgggggttagcggcgagtcacacgccccctgaatcttcttcagccgattaaaaagtgtttcaccatgccgcatcatatatagtgtctttgccaatttaactaacctgcctttaatttgtctttagataagcataccataaatgaaagcgctatttaaagccgagcaactaggtttcgttacgatctcaacagccaaaaaacacggccagattggtatccggccgtgctttaaacaaatatattgattaagccactaaaaatcgacgtgcacgtttgacaagcagtggcccagccactaatacaccaacccatgcgatcaaagcaagcttcgttcctaatgttgtgacgcgactagcttcatatcttaccgttagcacattcttaccacgtcgctgttttagactcaagttacctatccaatgatgcttaatttgttcagaggtaacccggtgaccgttcaaagttagcaccgtacgtcgataagcaactacaggcaaggcacgcattttagtgtgcttcgcattccaagtcaactgaatgccattatgaatgacttgatgtttgaacttggactgttgcactgaaaagttacgccggtatgcacgatagacattgctatgggtttcaattttctgcgtcaccggaatgtaatccggcgtcgtgcgatcaacttgctcaattagctgattaatatgtcgtgtatgaaaggccggttgtaattgcttaatatacttcaaattagaatggacattatcgtctgccgtctgcaatcctgctgctaacggagttgtatcaataatcgtataatgaacattctgagcaaccttttgcgtacataaaagtaacgacaaaaggcttaaaaaagttccagcaatcacaattcccttatgcagggctgcgcttttttgactagctgcaacatcctgataaatcataaccgttgctagcatcatgaatggtgtcccaaccaaagaaattcgtcgtggcatttgtaaaaacgattgcaagtaaggcatcgacttttgaatcgagtcccacggaaatagcccggttccaataagaatataaactagcgcgacacaagaaaataatttggtgaacgcacctaaccgggtccagaaaacaatcaatcctgtgagcatcgcataagcaatcattgttaagacaatatcactattagaagccaccccattgtagattggctgcaaaatcaaactggcattcggtactaaatccatcgcaactggtgaaattagcgtgttgccacgatagacttccagtaatggcaacagcgtattaagactgagcaacaaggctaataagacaccggcaaaaaagtttaacagcccattcaaattaaacttggaatgccataaaccacgtataaaaaatggcaccaataacggtaatactaacgcgaccgttaaaatctgaaattgggccagcaaaccaatgaatacacccaatttcaacatagataatagttgccaatcaccggcatataaatcaagaattggccccaccaataaaggtagtaatccaaaagcaattgagcgccatgtaacaccaaaaatgaatccataaacaacgttagagctcaaaaagatgacgcctaacgcgattgacacccgttttgaaaaacctaaccggcgaccagctgcatacatcacatagccactgacaaaatagacgataaaaagagttaagatttgaaatctaaaccagttgccgaccagtaacaacagcccaccagctacataggtaattaatggactatataaactattcacaactcgaccggcctgctggaatgaataaagattaataaaactaaaattatgatttttcagttgcagggcagcttcataaattcggttatattgaaagtacccatctactcccagtaacgcatgattatttaataacaatggactacacattaacaacacggcaagtgcaatcacgataattgccgctttgttcttacgcataaacgcttcctccccaatgtccctttttcatctccgagcaactcttatcaagcgctctaaaataacattatatccgttttgaaacactgatactagtgactatcagtgttaaaagctactttcacttcaccaagccacttgcttatcagctttaaataccatatgcaatgggccacgtgactaataatttagcttgacgacaaaataaaaactggtttttcttgaaatactatctcacaccaatctcaagaaaaagccagcatctttattattaatgttactcattatgattcaacaaacatcagagtacgtactgaatcacgcctaaaaatccgtatcttcatttccctgattcaacgctgtcaacgccgcctttaacgtgtcgccatgtgcaatcaccgtgccggtagcgtggcccggttcaccggtggcttccacttcatcataaatttgtaaatgattgtagggaaatgtattcgcctgaacatagactggctttagccggttaacatccggatagtcgtacatcaccttagtcagtgcttcgcctaatttcacgtgaagtaatagtcgggtcacgctcgacccactggccttactgattaacgccatcgtagcaatgctcatcggttcaatcgtagcaagttgcaaagctgtatcagcaatcgctaaccgaactgtatagagcccgggcgcacccatggcgagcactcgttgcttgatttcagcgtgtaaagctgtaattgcctgattttccgccttatcacgaatcggaaatacttggaccgcaccacggacattgccacgcaaattatttcccgcaataatttcacttaccccgaaaattgtcacatcggtgccgtccgtaatcacctcgacggcgggcgaatcgttggtcttgatctgctcgcgcggcaagctattgttgatttggatcacttggtagccatcctgtactaacttctggcccagccggtaatcatgataggtggtaaaaacaatcaacggcttttcaatcgctaagacgtttaaaatatccgaatactgtttaggttcaacgtaacgttttttggccaatcgtggagtcatcgccacactattagggttagcgttgatcaaaacaggctcataatcagcctttttcaagtagaacaacagttgtgagaccaaatagtcgttcccatggttggttccaatccggttagcacccgtgccaatgacaacgactcgccgaccagtagacggttgactttcgttatcaaattcgtacgtggagtaataagtactcgtctgctcagtaaattccccggcagtcggttcgacctccttaaaagtcggttgaatttcattttccaacgcaaagttgcgaaccttagccacatccgtttgccaggcagcggccgcatcttcatcggtaaagccaaaatatttggctcggcccagcgcgtggacgtcaaacggccgttcacgcaaggctcgttcaatttctaaaatatgactcagtttataaaagtaaaaagcatcaatcttggttagctcggctaattcatcgatttgataaccacgattcagggcttcaagtaaaatcagcatgcgcccagcttgcggatgaatcaaccgttggatcagttcaccctccgaatagttctggggtcgattagcaatcacgtgatagcgagattcgtccgtagaccgcaaccccttcaacaaggcttcttccgttgaacgaccaataccgatcactgagcctgtcgattccgtcacggtgtctagttgatgactaactttcttcaacacattaaacggccaaactggtatccggcaaacaatatgatctaaaacgggttcaattaaagctgtttgtttacggtaggctccgggcagtttgacctctgccaaacttatcccgaccattatattaccaacaacttgtgctaacggatactcggttgcccgcgcggctaacgccatcgtccgatcaaagtacggtgtcactttaatcacgtaatagttttgcgtggtcggatcaagtgcaaattgaacgtgacaagagccggtcaagtgtaacttgcgcatgatcttgagtgtcgctgagcgaaactgttggtattcttgatccgtaatcgtttgcgttggggcaaaaacgattgaatcagcggagtgaatcccaactggatcaaaattttccatcccactgactagtagcgcggtgtccttctgatcacggacggctacaaattcgagttctttatagccgacgatactctgttcgacaatacattgtttggtccctgaaactttgaatcccattgctagtgcccgttgcagttcgtcttcatcttcacatagttggcgactcgcttcgattcggggtgcgaccgacttgacgatcactggaaaaccgacgtggcgcaccacggccatcgcctcagtcgtgctagccacaacttgtgaggcaatcacgggttcacccatatctttcaaccggttgctcatcagcgctgggttgacaatcatgtcgaccacgtcttgatcccactgtagcaacttcacgtgattattttttaacacattgttgcgaatcaacccttgaattagggtgactgtttggacgccaccaagtgaaggaatgaggccatcaggctgttcagtttcaataattttggatagtgcggcgacggtcagtggttctaaataaaccttgtcagcaaaccgattttcagccgccacggagtaagcattgttatcgacgaggacaacagcaatgcccagacgccgaattgccgcaccgatttgggtcaccgccgcgtcgtgttgtccctctcggccaatgtcattatgcccagcgccgataatcaacactttttgtaaggcttgattgttcaccagattggcccccttgcttgttgcatcgactcaacaaattcatcaaaaatatcgcgcgtttcagtcggaccaggagcgccatctgggaaaaattgcactgaaaacgctggaaagtcccgtagacgcagtccttgaatcgtcccattgatcaagtcaacaaatgtcgtgattaacttattacgatcaacagtatccgcatctaccgcgaacccctggccctgagctgcataaataatttggttcgtaatcacttcgcggattgggtggttagccccatgatgttcaggtgataatttcataatttgggcgccattggccatcgcaaatagttcgtggcccagtccgatggcaaacagtggcacccgattttgaatgttcttgatcatctcagtcacactggctggtaagtcctgaggtttgccgggcccagtcgatagaatgacgccgtctggatctaagtttaaaatttcctcagtcgttgccgtataaggtaagaccgtgacgttacaagcacgcttactaagttcgcgcaaaatcccgtgtttgaggccaaagtcgatgaccacgacattgagccccgttcccggattaggaaatggtttcggtgttgcgaccgctgccacctgttgattagtcagcacggtcgcacccaattgatcaaaggcatgggcatctgcaacgtctacgatactggctttcatcgggccacttgctcggagttgcttcgctaagtgccgtgtatcaatatggctgatgccaggaatattttgttgctttaaatattgatccagtgaccagcgccgctgccggttggtcgaaatgctagcaacatcccgaacaacgacccccttaacggtcggtaaaattgattcgtagctatcgtggttgatcccatagctcccaatggttggctgcgtaaaagcaacgatttgattatgataaatttgattagtaataatttcttgatagcccgtcatactcgtgttgacgacgatttctccggtagaaaccgctggcgagccaaagccttcacctaaataggcgctgccatcttcaagaatcaaatagcggtctgccattgcgatcccttctcatctgtttgactttgtcgtactagttaataatttcaataccatcgtgaccgtcgatttcattgaccgtcactttgatgcgttcttgacgcgcggtgggaatgttgcgaccaataaaatcagcgcgaatcggcaattcgcggtgaccacgatcgactagcaccgccaaggcaatgctctggggccgaccgccacccattaatgcgtctaaagccgcgcgaattgttcggccggtaaatagaacatcatcgactaaaatgacccgcttattcgccaccgaaaacgttaactgatagtccgttgaaagccgtgcttgatccagcggctgatcatcacgaaatgccgtgatgtctaactcgccaactggaatcgcagtaccttcaagctgttgtaattgggctgcaatccgctgcgcaatatagacgccgcgggttttaacgcccactaagacgacatttttaatgcctttgttctgttcgataatttcataggtgatccgggtcaatgcccgtttcatcgccattgaatcaacaacttctttttgcataattgcctcccaatttgtggttatcgcttttttgagcaacccgtatgacaaagaaagacggccggacaaggtgtcacggccgtcgacgaaaagttattgttaacagtttgcctttcagtctcgcagggccagattaaaggacgctcattactgttagattaatgattcccatcggttttgtcaagcttagccaaggttgttgtaaagatcggtggtagtggtgcctcaaaggtcaacaagtctcccgttacggggtgcttgaatcccaataacttggcgtgtaaaaattgaccgtgccccttaatcgtctttttggggccgtacaggggatcgcccaccagcggatgtccaatagattgtaaatgaacgcggatttgatgcgtacggccagtctccagccggcaactaatcaaagtatagtgctgataacgtttcagtactttaaaatgggtgactgctggtcgcccggtcttaatgatggcttgctttttgcgatccttcggtgaccgaccaagtggcgcattaattgtccccgtatcctctttaatcactccgtgaacgagtgcgacgtattctcgcaagttagttttcgccttcagctgggccgccaacgattggtgagcccggtcattttttgcgaccatcaataatccggatgtatctttatcgatgcgatgaacgatccctggccgaaattcaccgttgatcgtcgacaacggactatgatacagcaaggcattcaccaaggtatggttagggtgcccaggggctggatgcacgaccatcccctgaggtttattgacaaccaagacgtcatcgtcttcataaacaatgtctaatggaatgttttctggctcaatcgttgtttgttgaaccgtctgtgcggcaacgacaatttcgtcacctggtttgacgtgatacttgctcgcctcgagctgaccattgaccgtcacctgatccgttttgatcagcttatcaacttgcgaccgcgtccagaccgactgtagtgccgctaacactttatccaagcgccctgtttggtcagtaatcatgaattgttgttccgtggtcgctcctgccacgttatcagctccctgtaacttatttttcaaaactatcatcccgcagcacgccgatcaagataaaaatgacgcccacggttaaacatgaatccgcaaagttaaaaattggaaaattaataaaatcaagttggaacatatcgacgacgtacccaatacgtaaccggtcaatgaaattccccaaagttcccgcaatcatcagtgaaataccaacctcatatagccatttgccacgtaagcgccacagcaagtagcccatcacgatcaaggcaatcactgaaatcaagtagaagaaccacatcttgccttctaagatactccaagcagccccgttattatgtaaatttgtgagtgataataacccggtaacaatactcgtactggcacccaacgcaatatgactcacaatcgctgctttgataacttggtcaataatgaccagcgctaccattaaaattaaatagatccacatattctgtcctcacatttcgctaagctgtgtttaattataccaaaagacgtcgtccttgtacgaaactccggcaggaaaagcgcggtttttattgcagacttaataactaagcacctttcgagtatcctcccaaaagcatcggcacctggttaaccatcccccagttgaagcaacgagcctgatgattggttgcaccgctcaactgctaagcgagttagtcatcatcggtagctcacaaattaaacgtgtgtgattgattcgctgtcgcagtcttccaaaaacagcgcaaataaaaagccgacccccactggcatcgacttatcggtcaagctttagaacaaacctgagatttttccatcatcactaatgtccatatcgagtgcggccggatgttttggcagtcctggcatcgtcaacacgttcccggtcaaagcgacaatgaaacccgcacctaacttcggcacaaattcacgaacattaattgtaaatccggttggtgctccgagacgtttgggatcatcgctcaatgagtattgcgtcttcgccatgcagactggcaaatgatcccacccttgcttagcaaacgttctcaattggcgctgagctttcgctgaatattcgacattggctccaccatacgtcttagtgacaatatcgttgattttcgtcttaagatccgcatccgctggtgataacggttgaaaatgacttggctgagcacataaatcaaccactgcggcagctaagtcggttgccccgtcacccccacgaccccagacatcagccaagactgcatcgactccaagatcggcacaatagtctttgacggcatggatttcggcgtcagtatcggccgtaaattcgttgatggccaccacgactggcaccccataacgttgcatggcatggatatgatgtcctaaattagccgcaccggctttcaaggccgccacattttcggttgccaaatcttgcaaagccacgccaccatgtaactttaaagcccgaatcgtcgccacgattaccacggcattgggcgcttgtccgaccgctggcacattaatatccatgaatttctgaccacccaaatcagcaccgaagcccgcctcggttaccgtatagtcggctagattcaatccagcttgcgtggcaagtacactgttacaaccatgcgcgatattggcgaacggaccaccatgaacgagtgctggggtatgcgccagggtttgaactaaatttggacgtaacgcgtctttcaaaagtaacgtgatcgcgccaccgacgttcaaatcagcaactgtcactggttgacggtcatgtgtgtagccaattacaattcgattaacacgttgtttcaagtccgcaatattttctgaaagacagagaatggccatcagttcactcgcgacggtaatgtcaaacccatcttcacgaggtacacccgatgttgcaccaccaaggccaatcaccgtatgccggagcgcccgatcattaatatccaacgcgcgcttccattgaattcgacgctgatcgatacccaactggttaccttgttgaatatggttgtcaattaaggccgcgagcgtgttgttcgcagccgtcagggcatgcatgtcgccggtgaagtgcaaattgatatcttccattggaatcacttgtgagtacccgccaccagtggcgccacccttcatccccataactggtcctaatgaaggttcccgcaatgcaatcatcgttgacttaccaatcttagtcaacgcgtcacctaacccaatagtcacggttgactttccctcaccagcaggcgtcgggttaatcgacgttactaaaataaggttgcgttgagttttcttaaccggtaacggtaatttaagtttagccttcgtgctcccatattggtcgatctggtcaaccgtcaagcccgctttagccgcaatcgccgtaatcggttctggtatcacttgctgtgcaatttcaatatccttcatcaattctccgcccttctgtttttacttactccattataacaatcttcctgaaattatgaacattatttgtatatttattgtttttattcgtatctatcgactagttgctaggccaatcaactgattgcgcgcctttttcaacatcaaaaaccgatattgattaccatcgatttgaactttcaacccaccgcgtatcgggacgatcaattcgagttgatcacggggaatcacaagccaagaatggttcaagaccgtgctaaaaataatgaggttatgattgattgttacgcgccgcaagctgatttgaatcgcgaccaaggcaataaagagcgccgcaatgacgagtaaccaccacttaaacttcaagatttctagccacaaaataatccccgccatcaatactagtgccgtccacgaccagacgataacacttgacgctagcattggttggtatttaaaggtatgcttatcgttattcacagtacaaaattcctttcacattggagtgagtttgatgcaattatatacggatgccgcgaccacacccgataatcagcgcagtgccgcgggaatcttaattattgatcagggccaacaacaccaattcaaacaggtcttgccagacagtgataatcataccgcagaatttcttgccgccattgctggctttaaaactttattagattcttatggtccgcaagtcagcgtctttttctatacggatagtcaaatcgtcgccgaaagtgtcgccaagggttacagcaaaactttcagtgtcgagctggcgactttgctgcacctgcaagaccagtgccaattagtaatcacccagtggattgccgaaagtgataaccatggcgcccatcaattagcacaacaaggcttacatcttagtgactaatcagccggggccaaataagtttcaattgatcgttgatactggtcccagtcatgagcaccagtttgaacataatcggctaacagcttaccaatcatgggtcctgttgttaaaccagatgaacctaacccgctagctaccaaaatatgtgggttatccggaattggaccgaagaacggcgcaaagtcacgcgtgtaggcacgcgtacccacttttacctgcgtaatttgatccttagtcaggttggcatcaagtttgagcccgctagcaaagagatcatcttcaaccagacttgaaacctgcaaatcgtagccctgatcattttcgtgcgtcgccccaacgaccaatttgctgcgcgtaaagggaataaagtctcgttcaccttcaggcatgagcactggaacatcgtcagcccaagtctcaggtagctgcatttcaatcaactgccctttttgtggccgaacatccgcaacaatcttcattggcaacaataacggctttagccacgccccgactgctaaaatcaacgtgtcatagctttgctgaccattaaccgtcaatagttggccctggtcacctaaacgtaccttacctttatgacggaccaggttccgcttttcagcgtatttcagtaaattatgtgcaaacttatcgccatcgacccgcgcaccaccactcacaaacacaccgggttggggcgccgttagcagtgggatccgttcttggacttcttcagcagttaatttctcaatcgttcccatctggggtgccgcttgccggcgctttagagctaaatcgtatagcgcctgcagatcatctggatcggcacgagtcacaatcgttcctgcttgttgataaacagaatagcccatttgcgtgtccgcaacaatttccggatacaaagcagccccggccttagcgagttgataccaacgctgattacgacgtttggataaccaaggtgaaataatccctgctgaattcttagtcgcttgaccaataccttcatcataaatcgtgacgttcaggtcagggttctggcttaaatagtacgccgtgaccgccccaacaatgccactaccaataatcgttacttgtttttgcattttccaacgcctccacaaccaatctgctttcattttagcatactcgaatttgttgcgggtggctgattcagttggattaaagtcagaccattggtagatgttgctagtactagctttgcagcgattaatttaataccgtggactggctctttgccccctatgactgggacagagcaatcaatagttgttgccggacaaaattttcgttcgtccagtgtaaataatgctgacctggtgcatgaactaggtgaccaagctggcaccacggtgattgttggtacgccgtcaagcgttggtcagtgactaaaacttggattggcagcgtcagtacccgcttttcagcggttcgaagcgtcgttactaattgtggtaagcattgcgcttcagtcagaatactcgggttcgcgtaagctgctaaatcaatacgggcattggcgacacgttctgccagtaggtttaaaggattaacttctgctaagagttgctgaagtgtcaaagtttgtcgctgttgtactagttgcggatagttttcaataaaagattggacgtttgcaagaagttgtggtgccatcgcggcatagggtggttcaagcaaaactaagccacaaacattatctaagtgctgctgggcatataagaatgcgtaactagcgcctaaactgtggcccaccaataataagttgctcacgtgttcatggtgaaccacatcctcaagattggctaaaatatgcgggacagtgcgcaccatttgactatgaatgctacggcccacgccaatcgtgtcgatggcaagtaatcccacctgacttggcaatcgtgccattaaatgcttaaaattataatcagtggcgtcccagccaaacgccggtaagcacatcaacgtcggctgttgtggtcccgccggtcggtactgatagtacacttgtcccaattccgtcattaattgattcatgattacttgcctcccacaatgacagacatcgtaagtagttccaaatgcttttttattacagataaaacacagctttacaatcagtcatgcatagtctagtccacaactgatcagtagaaaatggtttttaaccgcttcgttaaatcaactgaccattaaaaaagttacaagatttaaataatcgtcacattttgaccatattttcgttttacacttattaatatgcacgactatattgttttaaaggacttttgccatgttagttattgtttggattcttttagttttattgttaggactcatgggttggttggaataccacaatcttcagcatccggtcatccagccagctaaaaccctggcgccgcgcgcacagctccaattgcaacatcaagtgcggcaacacgtgaccgatcaagcaccacgattgaaatggttatattatggaatggcagcttgctggtggctcggtgttatcagtttactagtcagttgctacttggtcagcgcaaaattaaccctgttgatttttccgattcggagtgttgtcacaagcatcgccttaatgatcgttggcattatcttgctaatgattcccgccttagtgtggccgacgcaaagttatgattacttgattggtcactcaactcaagaccatcattggcagctagccgataccgccacgtttgaacactatcgtcgctttcagatttggttggttttggcattagacgtcttcatcctgattggttggattagttgggcctaccgggtcagcaccgttcccatggtcactattgagtacctactaatggtggtggcaatcgccgtaccagttgtggcattgatcacgctgttagcacaactgccatacttacatcaaaaccgatacttgattccggtcagcgggcgctttggcacccagcattatcatgcgaatcaggcactcatgcaacaacaaccggacttaaagtcacggctaattatcgttaatgttgttcggattattggttacgcgttggggttgtatgctttatggttgttatatgccaacattcttgcaccggcctttacggtcgataccagtatcgtttaccccgcagcggcgtttgccatcatcggattgttaatcgtgttaacagcgggcggtgtgtggcttccccgtttctatgattacttgcaattattagataacaagaccttgacgttcaaattggccggtagcgaccgcttccgtcgttttcgttttcatttgtattacttcaagttggcattcagtattttatggatcgttatctgggcattgatcatcggttatatttattactttggctaggtacgctcaccaataatacgcaaaacggtactcaaactaatctgagtaccgttttttagtgtcattttatgagacttgccagcgaggccaacttgagcgccaaaggactcaaaataagtgtcgccattgcggcgcaagagccattactgttatattactgcgttttgaagagcgcaacaaagtcagcttgcgcgctcgcagcttcaaacgttcgcttggacagtgtcgtcacctgccgatcattgagccacagcacttggtaatctgtaaaagcatgaaggtcgcgaacgtcatgtgtaatcatcaagtaggttcgctcaggatgggcttgcatgacctgaaacaacaactgcacgttttcccgatcgaccgctgctgttggttcatccaaaacaatcaattcgcgatcaacttgtaagaacagcaataactgaactaatttgcgttggcccccagaaagctgaccataatgctgatcccacaacggggccaagaattgataagcttgggtatcaataagttgttggagctgttcagttgtcaatcgtagtcgtccgtgctcgatgcccaaaaccagttgggcaacgtcccgcacacgaattgaagacagtaacgggagttgttggttcaaataaatggctgctttaggtaggtctaattcaccttgtgccggccgcaaaccagtgatgatatcagccagcgtcgtttttccagcgccattttgaccaatcaaaaaattgacaccgggactttttaattgaaaactcacgtccttgaagaacggttgcccatttcttgaaaagtaatatgctaagtgctcaacacgcatcattataagccctccgttggcagaatcttaatgtgccgatagctaaatccgccgataaccaataatacaatcagactcagaagataagtcgtcataaagtggctgacggggcccacgctgatcatcgcaaaaacattggtaactaagtaaatgggactaaccaggttgagtaatgggttattggcagacactgtcagcatgttacttaacataaaggtacccacgacgataatcatcgccagtgcatttccaatcatatcgacagttttacgtcggagtgccaaggcaatcaagggtaagccaaaacaagtgactggtagatacgtaagcaacacggtcaaccataagcgacctagcaacgataaaaaggccaacttgaaagtaatcgcgctcaacagggccaccaacaataaagtcatcaaaattatacccaagctgaccagcgcttgactgacaagaaaaactgcggggctaaccaccaaggttcgatattgtttgagataaccctgctcgcgaagaatggctacattactggcagtcgttagacaatttgaaaaaatcatccaaccaatgtagggcatgacttgagccgtataagttgtcagcgataaaggtttaaagaaagcgctactgacattcatgattaaaaagacaagtggcaaacagatcgtgtaaattaacaccccgggagtatcccgaatgaccttaaaaaaatactgcgtgtagccccccacttgaatgctatatttgtgcatcaccatcacactccttttgttaatctaattgttttattatatgtttatcatttatcaaaaagcaagtattcttatatcaggcatgtaagtatggccggtttacaaagttttctgcgactaccattctgaataagataagcgtacaatgagaataattttcacgaaagaaggtttcatttatgattcgagctgttcaaattactgatgcccctacgattcagaaattaaacgctgaccaactaaactatgactatcccttaataaatacgactcaaaacttagctcgcttactgtcacaaccagagcggcatatcttgctagcagcgaccagcgccaatgatcaacaagttcttggctatgtccatgctgaagtttatttagaaacatatggtccagcactattcaatatattggcactcgccgttagcactaccgtacaacatcgaggcgttggttgttccttaatgaccgcattggcacaacaagcgcgcctttatcacgtcgctggtattcgattgaattccggtatcgaacgccaaggcgcgcaccaattttatcagcaaattggttacaccgcgactaagcttcaaaaacgttttttcttggacctcgagtctgaccaatcaccgactgaatgagcttactcccaactcattatgttttgatgctcaccaacaacctggcaacatcaactacaaccccgttgactacctgttgtggttcgcggttttggactaatttataacgattattagtctaaaaatgactaaacgtcaccgttcgagcctgcgcatcaatccggacatccgcccccaatggcgtactgagcatggggactgtatggcagctatcgtagtcgtaaataattggtaattggcgatcccccagcacctcctgtaagatatcgattggcaaccgcccgctgccttgatcatcgtacaacgcgtgttttcccaaaataatgccagagatttgatcaaaaacaccagccaacgctaacattacgaaatttttttccagcgttgctgcagttttctcggcatcttcaataaataaaagctcgttaccagttaattttggaaaataaggtgagttaaagaacccgtacatggtgttcaagttcccaccgatcaaacggccagtcaaaatgggggtcgccgtataatgccaagtatttgcgtgcatgtgtttcggatgttcaaaggtctcccaattgaccgcttcatccgtccactgtgccggtgcctgttcggttacggcctgccccggtgctgcgcggtagactgtcagaaaattctgccaagtggttgtcacgatctctgactctaaggcgccaagtgaggctactaaggccggtccgtaaatcacacgacaattaggcgcgtgcgtttgcaccgccaataacacggccgtcgcatcggagtaaccgacaattgttttgggatgctgattgagatactcgtaatcgagcattgctagcaccgaatttgcgttcgtcccaccaatcgttgccatcaagatgtccagcgaatcatcatgaattaacgcgttgatttcggccgcccgttctttgatggaaccagcacggtaactatcccgtcgtcccgtcaaattaccggcaactaaggtcactccttgggttgccaagaaccgtcgtgcgcgagcataacggtttggcgataatgccgtaatcggcgttgatgcagaaaatgtcccaattttcattgtattcccacccccacaagattaaaatataattaaaataagtgtagcactttttaatcttaacgtacttccaatcgacgtatttcctcaaaaaaacgactttcagctaataacttgctgaaagtcgtttagtaatcaactggctatgctcgttttgagcgacttaattgacttattgtgtgaccacgtttgagcggttggctgaaacgtaattccctttattcgttaaataatagcgtgagccacccgaccgtgggtaaaccttcgttactttaattcgatcaccagcggcgtggtaagcgtgtcgattagacttaacaaagtttgaagatttataggtgtagagtcccactttagtcttgatccagccactggaaggtactgattcatagtaccaatgatcagatttggagaccttcgccgtgatataaccaccactcaccttaattcgatagaaattcccacttttaaccaatttaccactgtagatgccaccctttttcaaggttttacccgtcgaggttgtcaaattaacatctttgaacaaagtgctcttttcacgaagttgatataatccgtgttggccgacccaatagccggtgacgtcctgtgataagacccatttatttagaccacttaagtaaaccagctgcttggaacgactcttagtgactgacttggttgctgtgaccttgtagtattttttcttagcgctactgggcacttttgtgccgtcataatagctcgacgccccattattgaggtacacatgttgccctttcgtataactgctgtaggcatacgtcgtgctagttgaactggtcgacgatgatgccgaagtcccggaagtccaccagcttaacgggtggtatgtcgtcacggaagcactgtcatacaaactgttatcaacatattgtcctagcgaagataaataatagctactggaatattgccacaatgagaacgaaatcgtcggcttcgaggagtaatttgcaatccactgggcatcaaaactttgccgtgccgtgttggcgtatgtggttgcaaatgactggtacgaataaaaaatcaacttcttgctcgttaacgaccgcatctcagtataccaagccttgacagccgcgttggccgccgtgctactcatggaagtcgtttcaaaatccaagacgtagaacttcgtgttcttatttgcgcgttgatagaacttatctgcctcggctttggcagtcgcggtactcgtaaaggtcgcatagtcataggacccgaacggaacaccatatttcacatagagactctcattagaggtgtggtagagatcctcataactgctcccatattgcacccggttgatgacaaaatcagcctgactcttcaaactttgaacctcggtactcgttaactgaccttgccactctgagatatccggcaccgccgcgtgtgcctgaacgactccgataccacctaaaaaacaacccacgagcagcagtatcaaccgccactttttctgcatgaccaaattactcgccttcccatcattagtttgatatgtacgtttactgcacaccttatcctaccgataaaatgtgcagataagttctcaaactgattgcagtcactttacaatttgtttacattataaaccaatgcaggaaagtgtgatttactagtgaaatgattcatgtggaaacttttctaatcgatacaggccttcatcatccgggtagattcctccaggcttaggtcgatacccgaagtgttggtaaaataagtgcgcagtcacggacgctggaatttctacacggtaggcatgactgaaatagacatcctgttcaagggtatgcagaatttgacgccccccccatgccttgaacctccggatcaacaaaaatcgtgaacagactgtactcacctgggcgcccccagtatgacccaatcgccccggtcgcaacgagttgctgctgaaaataaccgacataaaagtgcgtcgcagcagctttttggcatagccaagccggtgtcatctgggtaatgagccgatccaagtatgctttgggatagtcaccctgattactcgtcagtaatgtgcgcgcaatcagtgccgccgctgctggcgcatccgtagttttaaaacgtcgaatttgtaatttcatatgacaactcctctcgtattgcactattctttgctcgttgcaatgaacaaagaatatctttttgatcgtctgccgataccaatttaacaatgactacttaagcttccacaaaccaaggttctaaaatttttaacgtggcttgctcaaaatcgatacacacttgcgccccatatggaagtgccgttcgcggaaaagcgtgaccaaaattaatattgtacagaattggcaatttcaaatcggctgtctcatcgatcaaaatttggcggtattcctgataataatgctcattctgcggcttacctacaatcacggcggctacgtttgtcaaaatctcagcttgtcgcattcgctgcagcatccgcttgaacaaatctggctgcggctgcgcgtcactcgtttcgataaacagaatttttccgcgccattcggctgcacatggaatcagtctgaactgttccgcaacttgccgttcgtctggataacgggtcgtggtcaataaatcataaaagctgtccaggcaaccaccaagtagcgtcccactgattgtcccgtgaccacgtaacacttcgtaatggtgcatttcggtgtgggtcatgcgccgtgttccctgcgccgattcactgaaatttgttcgttcgtcataccacacgggactgctaataatgcttgtctgctgaggattttcaaagtaacgctgccaagtcttcgtggtatacggcaacatcgtcggccctaattcggccaagtcgcttaaaaaattggggccataaaaagtttgcagtccaagctgataaaacatcaaatgattgatcgtcgtatctgaaaagcctgtaaacagtttaggcgaccgccgaaccgccgtcttaaactgctcatcagccatcaaaaatggcacggttcgatacgtatcatcaccgccaattgccgccacaactccacggatacttgggtctaagaaagccgccttcaaatcggcggctcttaattcagggcgttgctgtaaaatcagtcgccctttcaaagcattcggcatcatgactgggacgagccctaattggcgcatccgttttagcccccgattcaattgatgctgctgcgtgagttctccgagcgtgccgctcgaaagactgacgacggccacgtggtcaccaacgtgcaatggtgctggttttaacatattttcaccctttcttaatttaatctaaaattaattttatcatcattatataatattttaaattgctatttagtttttattcattttcaatgtaaccaatgactaaataggtcactgagtccgctgctctgcatgactcagtgacccgtcgccctattgtagccaatcttttatgtcaaccaagcgaatcttatgcgtacccgctgaccatcgttctggctgtgccttaaccattgtcagcaactctgttagtgactcggaaccaacaatcaactgttgcagtaattcagaaatcagtggagaacgtggttgcgcaccaactaataaacaatgttcaccttcaaaggctaacacgtcacctcccgcccgtaaacgcccaaacggtcggtgcaacttgacggtacccaaaatcagcaagccaccttgttcaaataacgttttcaacaaccaataatcgagtttaaagtggttagaccgttgtcgtaaatcggccggcaatgctttagctaccggtataatcgttttgaaattccgactatactgatgccacgattgagcccagtcctcacgctcacagataaatcgccggggtaatgtcaattgacctacataatcacaaatttttttaatagccggatcactcattattgacggactggcttcaaaagtaggacgcaattgtcgtatcagttcaataaactccgctagataatcggcaaagcctggcgttgctaaattaatcaaaattcgcttagcgacgcaataagtcaccgcatcctgatacgtcaccttggcgtgctcaatggcatcttgataggctgtcataatatcaaacagtcgtgggttggtataatctaaagttgtcgaaccagcatgtttataataattataaaatggttgttgcacatatgcgactcgctcacagcaactcaacatgtccagcaaaatatctaaatcctcgtagaccatccgctggtaacgatatttctgccaacacgaacgtgcatataatttatttccggaataagcattatttagaccgtatttaagataagccgcaattgccacgtgatcagtcgcatctggcaagctcagcagactagttgtgcggtgagtcgccgcgtagattttacgaacatcacaaacgacgatttgggcatgactacgctcagccgttgctactaaggtcgcatacatcgtcggttcgacccaatcatcagcatcgacaaaacctaaatagcgaccatgcgcggcggtaatccccgcattacgtgcaggtccctgtccttggttacgttgatggataacccgaaataggtgcggccagcgctcacaatattggtcacaaattgcagccgtgccgtccgtactaccatcatcaacaataatgacttctaaggccgctaatgtctgttttttttatgaggtcaaacaacgccttaaccagtgctcctcattacatgcagccacaataacagaaacttgaacttgcatactgattcccccaacgctcaaaatgatttcgcttacattatgacacacatgcttcgcatatcacagcacggatccatgataaggataatcatgcgcagtcgtggtctgatactctcgtaaatcgtcgatacgtcctgctaaattaaaatgaactgccgaaagcccatcaaactgagtcatccggtcagtaacagcggtgaaggaccactgggcaaagatcatgttgtcagttactgaccacaaccgctgaatcgaccacgccgttacccgttgaactcttaattgatgttcaatccaggcttgaacttccgctaatgatagatatgctggtccatagcattcttgataataacaatcgaccgcaaatattcttggtaacgcttcaaaatcacgagtgacccacatcgcaaaatattgctggacttttgcttttcggtcccgaagtagtgccgtttcgatttcggtcatttataacaccttccgttttaagattactttttagaggccgtaattctagttaataaacaggcgattaccattattttaacatcactaacaattaacaagaccaaatattgactaaacaagtctatcagttgtattcagcagtcatttctggcacagttaacttaatcataatattaataaagtgagccgataaatatgatcaaagttactaaccgacactttcaagatgtgcctgcgctggaagttgttactacaacccatttagaccaaccgctgccactagtgattttttaccacggttggcagtccaataaagaactcgtcttgacccaagcacgtaaactggctcgcaagaatttacgagtcgtcttgcccgatgccatgaatcacggtgaacgacaccaaatcgttagccagattccttcatttactttttggaacagtatccaaggtaatcttggcgaattcgagctaattgtgaattactaccgggagcgtaaactcattttgaatgagcagattggtgtcggcggttattcaatgggtggcatgacgaccggggctttattgacccatcatcctgaaattaaagcagccacaatcattatggggacccctaacctgaacgcgtacgcccaattagtccgcaaacatacgcaggcccatgcttattacattcccagtgatttagccctattgacgagttggctagatcactatgatcttaacctgcaaccggaaaccatcaatcatcggccacttttattttggcatggtactgaggatgaacggattccttattcacagtctcgtaatttctttgaccgcgtgcataccgccccgtatgctgaacaagtggcatttatcacgggttatcaagccaaacatctggtcaaagtgcctctgatgaacaaagttgctaatttcttcgattattatttaaattaattatcaaaggctcaaccatggttaacgttagccttaaaagagcgtgcttagtcggtcacccgattaaacacgctcttttaaggctactcaaactatctgtcacacattgtaatgatcgttattgtcagctacaagttctttgaatttcttatttgccaagcacaaccggcgcctatagctgaaatcaatgctgtactaaacatgactgtttgaaagccaattgcattcatcgcaggtacccgactactcactgtaaacaccaccacagcaattgccgtgccagccgcacctccaagtaaccgaaaaacgttgtaaattccggctgccttaccgataactgccggtgacactccccccaaaactgcatgctgtaacgcggggcccgccattgacaatcccatcccagcaattgccagcggagcaatcatcataacataagcaacatggttggcaactaggtaaccaagcatgaaatacccaaatgtttgagataatagcccgataactgccacaatcgcttccccgtagaggtccacagctttgccagcaaatggcgcaactaatactagtgtcccagtccaaggtaataaggacaatcctgcctcccacgcattatcatgctgaacaacttgtaagaattggggtaaaaagaaaacgactccgtacatcgcggcatataataaaaaagtcgccacattttccatcgtaaaaatacgctttttaaaaagcgttaacggcattaacggtgcaacgacatgttgctgtcgcttgataaaccaagtgcctgcaactaagccaattatcaggccaacgaacggaccaagtccattaatactagtcgaactggcagctaaggcccaaatgattgcggtcatcgctaacattgaaagacctgcgtccgttaaattaattggtgttgctaccccggtactttctggtaaatagaaccgggataatcctatgacaatcaggccaagtggcacattgatccaaaaaatccactgccaggttaatttagctacaattagaccacccagagccggcccgacaatcagtgccagtccaccgataccgctccagattcctaaagctttcccacgcttcgcaactggaactgcagccgttaaaatagccattgacatcggtgtcatgacggaggccccaatacctgcaatgacacgtgccactatcaataatggcattcgattggctaatgcacaaaacactgaacccagcgtaaaaactaaaatgccgagattataaacccggcggcgtccaaagcgatcacctaatgcaacgcccacaagtaacgttgctgcaatcgcgacattgtaagcgttgagggcccactgtaaactggcctccgagatgtcgaaatcaattttaattgctgttgacgccgttgtcacaatcattgagtccatcattgccataaaaaagcctaatgaagttaacgctaataaccagccaaactgtcgctgtcgattttccatgttttccgccccattatcatttattcagacttaccaatgctgaataagcctactcacaaagtttaaatctactatgtcaatctttttcttagatttagttgggtggccacccacaatagttcaaatatttttgaactattacagcgtaccatcccactaacgattcggcaacaaaaaaataccagttcaaaagaccaatcggcacttaagaactggtattagtcagaatcacagttgaagaccgcccaaaatactcagcaatttaaaggctttgataaaaatgggtaacatagtgatcaaaagttttggggttcaacatgacgtatttttcacgtgcaacttttttgacggttattaatcctgctttttccagcaatttaaaatgatatgaaccagcggttttactaatccccattgcttgtccgacttgcccacaagtaacggcctgatcctgcagcttcaaatacttaacaatgttcagtctaaccacgtcagccagcactttaaatactaatagctgctgggaatcaacttcagaccgcggtatttcatttgccaatatttttcacctacttttaccaacaaaggtcgcttgcttattccgtccgtgctggccgaattcgtttaccccaatattggaaataatctgtccgtaacgcaccgttatagagtttccggcgtttcgtggctttttgtccatagaagtcttcaaattctaagtcactggtcaagatatacttgctccaacttggcaatttactgtaaacttggcccatttgccgatagagaatccggacactatcccgatcgcttagccgctccccatatggtgggttcgcaattaggaccccgttgatcttgtcagtcgtaaagtctttgacggccagttgtttgaaatgaatgtcatgcaacaacccggcttcccgcgcattcagcttggcgatatcaatcattttaccgtcaatatcgtacccactaatatccagctcagtgtcgtaatcggctaaactatcagcttcgtctctcaattgttgactcaggccagcgggaacccagtcccacttttcgcacgcaaatgcgcggttgaaccccggggcaatgttgcgcgccagtaaagcggcttcgattggaatcgtccccgaaccacaaactggatcaacaaatggattatccggataccacttagctaacatcactaaggcagcggccatgttttcttttaagggtgcgccccccttttcgactcggtaaccccgtttgaataaactagagccagttgtatccagcgttaacaacacgtgatccttattaatagccacttctaatgggaacaaagcgcctgtctccggaaggtgcccgctccgatgataagtatcggctaactgattaacgatcgcctttttgacgatagactgcacgtcgggaacactgtggagtttagagttgcgcgatttaccttcaactggaaattcagcgtccatcggcaataactggtcccatggcaatgcgagagtcttttcaaacaactcatcgaacgtataagcatcaaattcaccaacgatgatcttgattcgatcagccgttcgtaaccacaagttggtccgcaaaatatctttgatcgttccgttaaatcgaacccggccattttcagtttgaacttgataccctaaatctcgtaattcacgccccactaatgcttcaattccgctagcggcggtggcaattaatctaaattcttgcatagtttcctcctgcgacgcctgttctgtaggcgcatcttgttgagtaaatatttccactaaattggtttcctcacctagtttagcataagttgctagtttgctaactgatcgaataaaaaaactgggacaaaagcgaacttttgtcccagtctcctgtctaaatgtaaattcctgtaggccatgttttgtacctagttaaagtacagggtctgttaactaggcggtaatcatctatctcgagattactaatctccccccacatttagttcagttccttatgtgaagcgcccctaccgtagtttgggttgcccgctcgtggggtttaccgcgttccaactcaaccgtttccaattgagtatcgtcactgtggcacttttcaggaatactcgggcatagccgaagccttagccgttttttccgccgttaccgataaatcggtaccccggcttattttttcaccgagcacgaacactacaagcatcgcagcttgtgcgagcatggaccttcctcagccgacataagccgaccgcgattacccagaatttacatcgaatcacaattatagacggtgtgattcattttgattattatctaattgggcaccaaagacatgacgttccaagttagacaaacgtttcagaatatccatattcgtcaccgtactagtcggttgagaagatggactggttgcaccgacagcgacttgcttggtaagctcgtcaaccttggcccgtaaccgttcattttcatctgaaagttgttggttatctttagtaaatgactcatagtccttaatgacattatctaagaagccgtccacgtcggcaggatcataaccccgcatctttggcttaaactctttttgaaggatgtctttgggagtaaaattacgtttagccatatttaaaaacacctcattgttattcgcgcgatacccattcggcatccgcattacttaaaacattgtagcagactttattcaaaattaaaaccattattctgtttttctgcatattcattggcactttcctgtaaccagtcgaagtcgatcagggtcaatgggtacggatgagtgtcactaaagttccgaatcaaatcatagtcatacgtgggtttcccggggttatctggatcatataccagagtggccgcatccgtatgggtaaccataaattcttggtaattttttaattgttgcggattttcatacggttgtttactgactggtgcatgaaaatcgacttgggccagcaaagtctgtaatttagcttggttattttcattccagcgcccaccaaattcaccatatggtaacatcattgccactttcaattctggatatgtctttttgagcgttaaccctacttccgctgtccactgttcaataccgagctgaccacccgttatcagccaatccataccatcctcgatctgcgtcgttaagtaattagttaacgcaaacttaataacttttagtttatcatcctgatcaccaaagacattcaactcgtaactccggtaaccactaagccacaaccggctcataaaaaagtctcctttctgtcactaaatcggtctaaatcagttaaaaactcacagatatttcacattccctattagttaatggtaaaatgtaacattattaggaggttgattaatgtgacgattcgctatccaaacggtcaagtttatcgccaacccggcccaactaaatcgaaatcttccaaatttgccaacgtcaattttggcgatcgtggaatgagcttggaacaagaaatcaatgatagtaacgcctattatcttgaaaataatatcgcagttattcataaaaagccaacgcccattcaaatcgttaaagtcgattatcccaaacgcagcgccgctgtaatccgcgaagcttattttaaacaagcttctactactgattataacggtgtctatcgggggaagtatttagattttgaggccaaggagaccaagaacaaaacggcttttccgctaaaaaactttcatgagcatcaaattaagcacatgcgccagtgcttagctcaaagcggaatctgttttgttatcattcggtttgcgagtttggggcgcctatttttgttaacagccagcgacttatttacttattgggatcatcaaggagatggtggtcgcaagtcaattccactgacggatattgaacatttagccgcggagctacattatcaaatcaatccacgcattccctatttggatgcgcttgatcatattattgatgagacctcatcaattcattaaaggagaacatcatggcaggtaacaatgaacagaactcacgggttgctcgcagaaaaagccaacctaaaccacctaagaaacactggtttcggcggattattttatccttagctgcactgtttgtcatcggggtactcgctggtctagcacttttcttctactatgcgcagacggcaccaacagtcaaacagagtgaccttgtcaatacggggaccgctaagatttatgaccagaacgacaagtatttgacctctttgggaactaacgaccacgaatacgttaagtctagtaatatcccatccacacttaagaatgccgtcgtctcaatcgaagatcgccgtttttacaagcataagggggtcgattattaccggattcttggggctgcagtcggcaacttaaaaggtagctcactcgggatgcaaggtgggagtaccttgaccatgcaactcgttaaacttgcggtcttttccaccagtacttcggatcgaaatttgaaagtcaaagcgcaggaagcctggattgcgcttaatcttgaaaaacattacagtaaatctcagattctggaattttacatcaataaggtctatatgggtaacgggatttatggtatggggactgccgccaagtattattacggtaagtcattaaaagatctgagccttagtcaactcgcactgctcgcaggtatgccgcaatcaccaacctactacgacccgacgacttatccatcatacgcaactagccgccgtaatctggtgctggaagcgatgtacgataacaaggtcatctccaagagtcaggaaactgctgctgaaaaagtcagtgtcaagacgggcttaactagttcgggacgttcaagcctagcgaagcatgaaaagacaaataaaatcttggatgcttacctgaacgaagtccgtcaagacctcctcaaaaaaggttataatttaaccgatggcgagaaagtttatacgaacattgacatggatgcccagaaacggctttatgacattgccaacacgtctcaatacgtcaactatcctaataatggaaaacagactttccaattaggggtatcggttgttgactcatacactggcaaggtctcagctatgattggtggtcggaaaaccggtaatgtcacgtacggaaccaaccgagctgtctggacatcacgctcaaacgcttcgacgatgaaaccgattctcgattatggaccagccattgaatatttgaattggccaacttacaagtcgttgtctgatacgaaatacaaatatcccgggactaccatttccgtgcatgactttgacaataattacttgggcaatatgacgatgcgtgaagcactggttcaatcacggaacatcccagcaattcgggccttacaagccgttggtaaaagccgagccaaaacctttgccaataaccttgggatgaacctcaaaaccgttaactatgccaacgggatcggtgctggtgtttccaccttacaagttgccggtgcctacgctgcgttcgccaacggtggtgtttatcataagccatactacatccgtaaagtgactacttctgatggcgttacgacatcgtatactagcactggtaagcgcgccatgaagaaatcaacggcatacatgattactgatatgctgaaaggggtcatcaatagttctactgggacggcgacaaccgctaagatcagcggcgtttaccaagctggtaagactggtactgacaactatgcttctcagtataaaaacaaagtaccatccgatgccgtcgttgactcatggatggccggttacacgaagaattattcggtcgccgtttggactggctatgataagtccaccgaagctggtggttatctagatacctcaaacgaaaagatttcacaacaaatttatcgcgccatgatgaattaccttcaacagtattcaccaaactctgattggaccaaaccaagctcagttggcacgactaagaagaacggtatcgaagaactttacgttgttggtcacctcttctccagtagtgaagcctcgtcaggaaccgctagttcagctagctctagttcaacaacaacgggtagttcaagcaccagcacagaagcaagtagtcgtagttcggaaagtagcagtagtagttccgaagctgcttcttcctcaagtagcgccgaaagttcatcttctgaatctagttcagaaagtagcagcagttcggaagcaagttcaagctccgaagcaagttccgaagcgacttcatcggaaacaccgaccgctgataccaataacacgactgaaggacaataagaatcacccaagaccactgaattcgattcagtggtctttttttatgtgcactgttttaccgaaataacacacaaagtttacataaactaaactcaaaatcaacgttaacacggcgaattaccactacaatacaaagtaacttaataaactgagcaaaccaattaagacaaaggagttgcatatcgtggttgccattaagctacacgaattatccaaaagttttcaaggtccggtaatcaatcaactcagtctgacgattcctgatcaacaaatcacggcattaattggcccgtccggttccggcaaatcaacgctcttaaacatgattgcgggtctcacgacacctgacagtggtcaaatttcatttgataatcagcccatttttgacgccgcgactcattggaatcagccccctgcccagcggcacttggcgatggtttttcaagactttgccctgtggccgcacatgacggtccaagaaaatgtcgctttcgctttagaaaagcatctgaccaagccggaattgactgctcaagtcaactgggccctcgaacaagttagtctgattgacttccgacatcgttatccacgtgaactttcgggcgggcaacagcaacgggtcgcccttgcacgggcactagcgacccaaccggatttgattttattcgacgaagctttaagtgcgcttgaccccgaactgcgcacacggcttcaattagaaattcgcgccctgattcacgaccagcatctgacggccatctttgtaactcacgaccgtccagaagccttgcaagttgccgaccacctcgtattactgcaagggggcaacgtggtgcaaacgggcacaccagcacagctgtaccaacagccaaaatctcaatttgtcgccaattttatgggcacccttaatcagatcaacgcgcaccaggccattcgcccggaatatgtcgcagtcagtcaaacgggtactcagcagcccacttaccaaggcttggtgcagcgttcaacctttatgggcgatcattttgatacttgcgttcaagtcggcgcctatgattggcacgtcaagacccagctaccctataccactgcaccgatcacattaagcatcgatccacatcaaatactaactttttaggagttgactcacatgtctaaagcagcaattatcacattatccacgctcggcgtgctcgcaattggcacgtcgctttatgttaatcaacatcagaaaaaaacgttaaccgccaacgcgcaaaccagtcaacaagtcttaacagtatacgctgctggacctaaacccctttctgatcaaatcatccacggttttgaagccaaaactggcattaaagtcaaaagttttgacggcacgaccgggaaaattttaagtaaggtcaaggccgagcaaggcaatccccaagctgatgtgctgattttagcttcaatggccgctggcgtcgatttacaaaagaatggccagctattaacctatcagccttctcaagctaaacacctgaataaacaatttaaagatactagccaccagttgatcaattacagtgcttcggcagtcggcatcacctacaatacgcggcacatcaaatcggcaccgacagactggtctgacttgacaaccactccgtatcgcaatcaagtgaccattccggacccccaaacctctggttctagcttggacttcattaacgcttatcaaatgaaacacggtacgcaactacttaaagcccttcaagaaaacggtgccgatatcgggggtgctaacaaggaagtactcgatgcagtcatcactggccaaaaaatcgccgtctttggtggggtcgattacatgagtctaacagctattaaaaaaggcgaaaaaattggtttcgtttatcctaagagtgggactttggtcaatccacgaccggcgatgattttgaaggctagtcgtcatcaagccgccgccaaacaatttattgactatctcttatcagctaaagttcaaagacagattcaaaaaagtaacttaattccaggtaccacgagcactttgaccgatccacgcaatggcgaagccatcaaagcctacacggtcaattggaccagtgccaacgcggccctgaccaaaaacgttgtcgcattcaatcaggtctttagccaatgagtaatcatcaaatccgcttgtccttatcaatcatcaccagttgcttgttggcaactctgattatcggcccgttagtcgccctgattggtcaaacactagtcgggcaatcgccaagccagctatggtcacaactgacgcagccaaccaaccgtgtgagcattcaacacagtctgttcctcagtgggggcacggtcgtcgggacaaccctgctagccacccctttggcatggatcatgacgcacacccgtttaacaaagctcgcctggttgcattggctcttgttagtgccattcatgacaccaccatatattaacgcgatgggctggttatatttctttcaaccacacggattactggctcagcttaatccgagttggcaccaccaatttcagtggctattttcaccgttcgggatggtcattatcatgagtctgcatttgtatcccgtggcatacttaggcttacgcgcagccctcatgcaattcaaccagcgctggcttcaagcggccgaagttcatggggtcaacacctggcaacgactagtgcgaatcacattaccaatcatgttagtcccatacttagctgtatggattttagtctttaccaaaaccttggctgaatttggaacgccagccacctttggtcggagcatccacttcgaagttctgacgactacggattcaaaggaacctcagtcagtggcccttagatttccaaaacggggtactcaccggcaccctcctactgaccattgccctgattgcctggggtatccagcaatggttgttacgccggccagctgttaagttcaccggacaacggtcagcgtcacaatatcggcagcttggagtgacaacattagcaggcactttcgtcaccctagtcatcagtattgctattgtcctgccattcagtgccatcgtgctccaatcgctactcaaacaacgcagtcttggttggagtccgtctaatttgacacttgtacactatatagacctcttacgctttgatagtcctgcctggcaggccattgttacgaccgtcggattggcattactgattagcagtctcaatgtgatcgttggtttattcttgagcgttgggagtttaacaaaacgttttcccaagtggctgcgacagttatgtcataccttgggcgcattgccactcgcaattccaaacgtcgtcttagcattgagcttaatgatgctcttttcacaggtgctggcgttcaccaaattatacggcaccctaaccatcctcctgatcgcggatgtcaccttatttctaccaacaacggtgcaatacttgacgaccgccctcaaggcctttgactcggaattgctggctagcgcgcgcatcttcgaacctagtttcggccgcattatcctaaaaattgcacttccgattctatggcccgcgctactcaacagctttgtgatggctttcattgccacgagtcgtgaattagtcgttgccctattgttactgccttccggtatgacgaccgtttcaacatttatctatcaatcgttcgaacaaggtgaagcggccgccggtatggccctagcggtattgacggtagcattgacattcattggactgattgcagctaatcacctgcaatcagctaccaagccagtacgccaaccaaactagcgcccaaacggcatcagttggcactcaaatcggtaatcgtcagtagcgaaagacgactttgttttttcgtcatcgcctgtcccaaactaaaaaggctggccgcacgagcatcaatgttgacgtcgtgtgaccagctttaatcatctctgacaagttatttagaatcgtcggccgaaacatcaccggtttgttcaacctcttcagcttcatcgctcggcatgttaacaacggtgacgttagcctccgtattacgaacaacatacgctgtcgttgaacctaagaacaggcgagaaatcgcattagttccagagcgaccaatcacgatcaaatcaatattttgggccttgggaacatcgaccgcaattgtcactttgggtaccccagtttgccgaattgtttcggcgtgcaactggtgggctgcaacttgatcctgggcccgctccaacagtttcttactctgggcttgatcaaaactcatcatatctggcgccgcactcgtaaaaacatctggactgtagacgccaaatcgattaacatcgatgacattcaataaaaataactgggagtcaaaaaccttcgctaaggcaatcgcatgttcaagtgcataataagcattatcggaaccatctaatgggactaggattcgtttatacatggttgagacctcctgataagttcaatgagttacaacatttattatcataatcataacttatctataatcatccagcacccaatatgcttattaattgtcaaaataagatagcggtttattgatgttaatcttagtaccgtaatatttttgcttgatatacttttgaatatccgcccgatggtaaagtttaactagtttaagataactagcacgatgctcgttcttagcggccgttgctaagatattaacattatccctagtactcttattcagactttcgtggaaaatcgaatcccgtaaaacgtgtaaatgtccttccaaagcaaccgtattcgaaatcaaaactgcatcgacacttttaatgatccggggaccagtagtatcatcgatctgtttgaatttcagatgacggggattgcttgtaatatccttcactgaacctaagacaccaaaattagctgccagtttgatcaggcccgctttttggagcagtaacaagcctcgcgaagcttgtgagggattgtcagcaattgcaatcgtagcgccatccggaatttcatcaacgctttgatattttttggagtagattcccattggttccaaataagtcgttcctaacgccgccaacttggccttgggattctgctgattataagtttggtaatatgaccaggactgaaaggcgttcacatcaacgttaccgtccgccgtggccttgttcagctgaacaccatccgtgatttgtttaaccttaatcgttaagcccatctttttggcatcttggcttttagcaatgtgctgccagacttcatagtccgatcccattgatccgaccgtaatcgtggcactctgttgtgtacgggccgaataactcgttatttcatgtaatcccacacaaataccaacaattgcagcaataccaatcaaccaccatgctaatcgtttcatcggctaattccccctttattaatgatgtgtgacgctcttaacgagccaatcaccaaacagctgtacagcaaagactaagatcaaaatgatgatcattgcgacaaacgtcacgtcgttttcaaagcgagcgtaaccaatactgattgcaatatcacccaagccgcccgcgccgatcgcaccagccatcgtcgtcagaccaatcaggctaatcaccgtcacgattgagacgcgaatcaaatcaggtagtccctctttcaaataaacccgaaaaataattgcaatgggactagctcccatggactgagcagcctcaacgattccttggtcaacattgagtaacgcattttgcacttgccgggcataaaaaggaaaaataccaaaaactagtgggactaacgatgccgtggtccccaccgttgttccgattaaatagctggtcaacggcgaaattacggctaacagaataataaatggcaccgaacggagtaagttggttagcttgtctaacacttgatacgaggggccatcagctaaaatgccatggggctgtgtcaccactaacagtacccccaaacccaaccccagtattcctgcaaccagcgcggaaactgcggtcatatagagggtctctaacgttgcttgaataaattcagctttcatttgtaagacattcggaattaatgctgtcattagtccaccattcccttcacaacttcttcattgataatgcgagtgtggacaccttgagccgacatattagtgaccgccgcattgaaggccgttaaatcccccgtaataatcgcaatcatgtcaccaacattttgaccatcgatctggtcgatattggcaaacaaaatgttaacgtcgacccccagcgtctgcgataactgcgagacaattccctgctttgttgattgaccaacgaatttgaacgcaatcagctcttggtccgctgctaattcactcaatttaatcgttttcgtgattcgctgaatggcggcccgaacattggtagatgtttccacaaaatcaacggtcagaggtgctttgggggctgtaaaaacctcagcaacggggccccgctcaataatccgcccatcagccataacggcgacatgatgacaaatactcttgatgacttgcatttcatgcgtaatgaggacaatggtaatccctagctcgcgattgacccgttgtagcaactcaagaattgccgccgtggtctttggatcaagcgcactagttgcttcatcagaaatcaagatttgcgggtcagtgactagtgcccgtgcgattgccacccgttgtttctgcccaccagataatttatctgggtaggtctgcgcatagtccgttaacccaacgagcttcagtagccgtaatgctttggcgcgtcggtcctgtttactaattttttgacccaataatggataaataacgtttcccaacacggtccgtgattgcatcaagttgaagtgttgaaaaatcatcccaacgtgtttcctggcttgacgtaatgcagctggcgatagcgtttgtaaggcctggccattgacgactacctggcccgttgtcggtgactgtaataaattgatcacccgtaccaaggtacttttgccagcgccggaatatccaataatgccataaatatcacccgtctggatctgtagattgacatcttgaaccgcgtgaacgacttggtgcccgtcgtcaaaagtcactgcgatgtcttttaaatcaatgattgcctctgtcatagtctgcttcctcccattaaaaaacgcccatcgtctctaatctgattatcagattaaggacgaatggacgtttttccgtgttaccaccttacttcaaatgaccctcacaggccaccgcacttcaagtaccgccactgaaaattcttagcgagactctaaccgcataacgggcgtagccgtcaacgcttaaccccgtcagctcagcgttgaaacttgcattataagaccatcttcaacgttgcgaaatggctacctcgcaccaaccggcagttctctaaggcattccaacaacggctactcatcttagacgtatttattaatatatttacttggttgtttacagtattgcgctattttaatgagaagtcaacatttaattataaccattttttaatttatagtggtgcccactgattttggtccaatgatgtgcatcccaccggcttaccaggacaggaaatcctggtggtcctgttttaacctcagtacgctgcgccaatgacgtgggcaaacgccattgatatgaaacaacgactaacccatcccgaaaaaaagtggtaacgacgcctcgcacaggcaatcgccaccactttatttaaaatcagttttccccgataagcttttcagcacagtgtttaagactggtcttcacctaatttgaataacggaatcttcggaccagcatttgcgcccgtctggcgttgtggttgcggagcggaattcaagcgttgctcaatactgcgttggcgctctgcttccacctgggcagccgtttttaagttacgcttctgccagttcaacagaattcggtccatatacgtcaagttatagacttgacgcagaactgcttcccgcaatgccaattcgataacttccggttcataatggtcttcgtcgaaccacttactaatactttccatttcgatcggtgataagtcacggccaaattccgtctgaattgcccgaaaaaccttttgccgactgttttcactcgtggcttgttccgaagcttgagtgctaacgggctgctttttgagcgcaactgctaacttatcatacaggccgtcaaaattataacggtcatgaattttttggtcatcagccgtgatcgattcaatcgtcagcaattttttggctaacatttcatgtagccgctgaaaaacagcatttgtcgattcacctaaactcttggcaattaccgcagcatctgggaattgattaccctgatcaattaaccgtttgaactgcaaataaaccaataattcatcgtttgtgaccccaatttcacgatagtgggccaataatgcgttcgcaatggtcgtttgaccatcattcactaacgcggcagctaaggactccatctcgttatcatcctttcactattaagagcgtgagactaggtcccacgctcttaataaaactaaccttcaattaaagtttacgggtaaatccggttcaacaaccgtgggaacggaattgtctcccgcacgtgatcttcggccgtaatccaagtcaagaatcgctcgagtcccaaaccaaaaccagcatgaggaacactaccatacttacgtaaatctaagtaccaagcatagtcgtctggatttaagccggcttgtttgatctggtcaagtaagtaattgtaatcagttgctcgttctgacccgccaataatctcaccatagccttctggggctaataaatccgcacaaatcaccacgtcgtcccgggttggatgcggcttcatataaaatggcttgatggctttcgggtaattcaaaacgaagacgggttgatcgaagtgatcagccaagaaggtttcttctggtgaaccaaaatcaacaccccaatccacgtcaaagtcattttcttttaacaattcaatggcttcatcgtaactgattcgtggataaggtaacttggtgtacttcttcaacgtttcaacatcacgacctaaaatgtcgagtgcgtattgacaatgatcaatcacaccttgaacaagaaaggcaatataacgttcttgaacttccaaactttgttcttgatgcatgaaggccatttctggttcaatcatccagaactcaattaaatgccgccgagtcttggacttttcagcccggaatgttgggccaaaagtaaagacctttccgtaggccaaagctccggcttcggcgtataactgaccactctgtgataagtaggcatcccgatcaaaatattcagtatggaacaattcagttgtcccttcaggtgcactcccagtcaaaattggtgagtccatcttaatgaaaccttcttgattaaaaaattcatacgttccgcgaatgacttcattacgaatgttcatgattgcccatggccgcttagaacgtaaccatagatgccggtgatctagtaagaagtccaccccatgttccttaggcgtaattgggtattcttcactttcaccaacgactacaatgtcttcaacttcgatttcataaccgaactttgaacgactgtcttcatgaatcacacccgtaatccacatactggcttcttgcttaacttccttagcgagttcaaaaacttcttcgctaacttggctcttaacaacgacaccttggaaaaaggcggagccatcacgtaattgtaggaaggcaatcttaccacttgaacgtttattagtgagccaagccccaatctttactttttcgtcgacatggtccttagcatcgataatgttgatctgttgcaccatttacttacatcctccaattactttgcttgttcagcaattttttctgtcataaatttttgtaaccgtcgatgggcctctcgcaaggaatcgatatcagttgcatagcttaaccgtaaacaaccgggcatgccaaacgcctctccaggcactaaaccgacatgggcttctaataacactgccgtcacaaaggccggtgcatctgcatagcctgttaaacgcaatgcttccgtaatatctgggaacaagtaaaaggctcccgctggtttgccagcaggcatcttaaacccaggtaaacgctcgatcagtgggtatagttcgtttaaccgcgcttcaaagccctgacgcatcgtttcaacagatgattggtcaccactaaaagcttcaatcgcagcatattgtgatacggcggctgggttgctagcagcgtgacctaacacgacccccatcttagccatgatggtttgtggcccggcagcatatccgatacgccaaccagtcatggaataggcttttgaaaccccattgatcaaaaccacgtgatccatattagcatcatctaattctaacacggatgtaaattcattaccgttatataataacttttcataaatttcatccgcaattaccaaaacgtcgtgttcaacggcccaattcacgatcgccgtcaattctgcacggctgaaaaccagaccggatggattctgtggcgaattcaagactaaggccttcgtcttaggcgtccgctgcgcttccaaatcagcagtggtaaaccgcaactgttcatcggtgctaacttcgactggcacaccaccagctaatttaacttgctccgaatagctgacccagtatgggactggtaataacacttcatcgtcgggattcagaataacttggaataacgtaaacaacgccatttttgcgccatccgttacgacgatctgattaggatcaaaatggtagtgatggtcagcctcaattcgctgactgatggcttgttttaaagctggtaatccagttgccggtgtgtagaaactcgcttgaccattttgaatactatcaatggctgcttgcttaatgttatccggggtctgaaaatccggttcaccgattcctaaattgataacgtcaacgccgtccgccatcatttgcttggcagtcgcactgatcttcaatgtcgctgacggttgaacctgcattactttacgcgataattccatgtacatccgcactcctttaaccttaaatgttaataattgatttcagctggtttccattagaatactgcaaaatttcataacataaattctttttctggttcaagtacgtaatttcccacacgaccgtcccatcatacttcccaagcgtcgctttgataaccttgctaggattgcgtttagaccagacctttttcaaggctttcgtacgtgaaatcccagcggactgtttgataacggtcgttttatgatgtttattcgcgttaattaacgcgtataccggaacatttttactcgacgttcccgtaacgacgtaataactactggtgccattgtactgtgaaaaggccgtcgtggtctttagcttgcccttgctgacggccagactatacgccgtcttctgggcttggtgcattggccgttgtgcggcccataacgtgccatagaccgccacgataatagctaaaatgacgaccagaataatcataatgagtcgctcagggcgccttctacgttgaactcgcatatgctcttcctttcaaaaacagataaattaattatagcaaatttaactgattgcggaatggtttcttacttagttttgaaaaaactttgaagttcctgcgtaatcatcgtcaatgaaccggttgcgggcggcaacgttttcggtaaagctttaagaatcgtctgcccgtatcgtttcgtcatcaaacggtcatcgagaatcaccgctgcccctcggtcttcatccgtccgaatcaaccggccgattccctgacgtaacttcaatgccgctttcggtaacgcttcgttatagaacggattgagttgtgcttgccttagttgttgataacgggccttggttgtcgtctggtcgggcgattcaaacggtaattgcgtgacgatcaacaattccaactgttcttgtggcaagtcgatcccctcccagaaactaccggcacccaggagaatggcatcgtccccctgcataaagcgccgaagcagcttttcacgactaccattgacgccttgagccaaaatttcgcgatcaccaggtagatccgtttgatgcaaactgtaaaagactgcttcaatcatattcagtgaattgaacaagaccaacgtttgcttaggcgctgccatcacgatgtcgtgaatcgcatgcgtcaagtatgccacgcgctgcttgccactgggtgcttccgccgcagtagcatccgtagcgacgaatagccgtgcctggtgttctaaatcaaacggtgttgataatcggtgatgcttagccgttgcttggtcaatatccaattgcgaataaacgtactgagatttcccagtggcaaatagcgtggcaccagttaatagtggcgcactgaagtaaggatatagttgcgtcttaaaatacccttgcgtatcgatcaagctacccgcgagcgtgagactgccgcgatcatgccattgattaaggctcacccagaagacccgttgttcccgcgaagctggcactaaccacgtttgtaataactcatagccctgacgaagatgttgaagacgattgtcaaagtcgtcgaggacgtgttgttcactaggcaagatttgcgattgatcatgttgatactgctcatttaattgttgaaactgtaaaaaacagttttcaatggccgtttgtaattgtttgatcagcggattgtgggccgcaaagaaatcagtcaactgatccgtggtgattcctaattcagcaggctgattgccgcccttttgtgctggtacaaacgttctggctagcgccgcctgcagttgttgcaggtgtaggtcagtatcattcaatgaattatctaataatttcagacgataatcggcctgtggttgttccgcgaacagtgcccgtaaatttagactatgttccgtgtcaatgcgactgatcaagctgtggcaggtcgccatgtagccattgaaatcaaacgtctgccgtgagtcacgaacgacgccatctgccagatgctgggcctcatcaagaaccagcagtggccgctcttgacggctacccagttgggccacgtggcgcatcaggtaggcatgattggtaatgataaaagtcgcttgcgcggtcaattgatcccgaaagcgtaagaaatcttctttaaaaaacgggtcatcagctttcaacgaggccacgccatgatgggcgatttcgctaaagtatggcgcttgatacgtgctcaagtgcaattcatccagatcaccagtcgttgtcatcgtcaaccacactagcacgcgcaacttcaataattgcgtttgcttcgaatgttcatgcaacgccaagccacgggcaaaccggtttaaatcaacgtaatgctgattacccttaatcacaaccgccgtcacaggattaggcaacaactgattcaacaacgccacgccctgatcacgtaactgcgtctgtaagaccgtcgtcgccgtgctaacgaccacctgttgaccatcctgtgccaagtaggcaagtggcagcaaatacccgagtgttttacccgttccggtcggtgcttcaatcaacaatggtacttgttcagcagactgttttgagtagtgccgataaatctggttcatcatccgggcctgttgtggccgataagtcaagcgatcaccaaagatatgctgcttttgtgcttttgtcaacggatagcgtgccgctttacgacccgcggcttgctgtggcaatcgctgtttacgcagagcgagcccgtttttgatcactaagtcagttggtaactgctgtggatgttgtttgccctgttgaaaggcgtatgcaaacaagtcagccgtttcacgtggtaactccggtgctaattgcaccatttgttgtaacgtgatcaatggtaagtgtgcgagccgctgttgtaacgtgataaacaagtgggccgtagcaattgcatcactatccgcagaatgcggatgattatggtcaatcgcaagcaagtgactcaagtcccgcaaccgaaaactcgaagcagtcggtaacagaatttggctaagagacacagtgtcaacggcctgaattggtagttctggataaccgacacgctgcaattctgaattgataaatggcaggtcaaagttcacgttgtgggcgacaaaaacagtcccttgtaataagctgtataccgtaccagccagatcatcaaagggtggtgctttgcgcacccgtgcattgctgatccccgttaaattctcgataacggccggaaccgttgttaacggattaacgtccgtggcaaatgtattaattattttattattcttaacaaacgcgcaaccgatttgaataatccggtcgccgtccttcacactagttccagtagtttcaatatcaactaccgcataagttgtgtttggtttcatggtcatttccccaagttatggattgtaaagatgttcattagattggttaccgcttgaatccgtcatcaacactaacgctgatgttcgaccaactaatcgatctttatggcatatcacgtgcgatgtgtttgtaatcagactgaaggctggtccaagtagcgctacacttggtctcgaccactaactttaacggttcgtcggtcagcccaacttagctgagttcaacctactaaactgtgccagtgacacaagtcgtcctgatgacgcaagccgcttggctcatcctccacaccgatcgtcacacatacgtcacgtcgatcattgtaaattatagcatattcggcgtagggaactcagcccgaccaactcttaagccaaattcgtcagtctgaggacaacgggcagagactggtcaagagtatgattgagcaacgataaagttcatgaaagtgtctcggcgtacatctgccataacacagtcagctgagtacgcgcgcttgaatagccggcactgctacccaaaatttactttcctaattagtgaattctgggccacgtagtccgtcacaagcagctcaacttctttttcatcattatcggactgatttctaatcatttactaattttaacatagtaatcgatcttcgtctgccgttgataaccagtctgtccatacgcccctcacgtgaatgatttaatttaattaaattgttactttccaaaccagtttaacttacatttcaactgaattcagcgcgttcgccggggttagcatggcaaaagaagtgctaataaggtattatgaagctattattaatctacttacagaaaggcagcgacacgattgaaagatctagctaccggtactagtcatgccaaaattattttaattggcgagcatggtgtggtttacggacaacccgccattgccttaccgatttcgaccatccaaatgcaggccattattcaccgccgtgatgcagcgcagacggtcaaaagccgttacttcaacggcgactttaagatgatgtctgccaacttaggcggtattcagacgctcattagaaccttgcttgcacgttttgatgcccccgagcagggcttcgatattcacatcacgagcgatattccctctgaacgcggaatggggtcctcagccgcagcggccgtggccgtaacgcgggctttttatgatttcttcgaccgaccactctcccaccaagaattattggccactgccaatgtggcggaaagttacacgcatggtcaacccagcggcctagacgttgcgacggccagtgccaaaagtcccgtctggtttgtcaagggtcgtgagaactttccgattccggtaaagctccccggctatttagtcatcgcggacacgggtattaaaagtcagaccaaagttgcagtggcgaccgttcgcaacttactaatggttgagggcgcgacgattcaagcacgcattgatgacttgggccgattgactcgtcagacccgaaccgcgcttgaagatggtgacatgggggccctggcaacagccctgaatggtgcgcaagatgacttacgttccatgggtgtcagtcatcctgcccttgaacaactactcgcagtggctcgccaaaatggtgcactcgctgccaaattaaccggtagtggtcagggcggttgcttgatcgcgctcgctccggaagccagcatcgccaaccaattatcacaaaaattggccgcagccggtgcgactgcgacttgggtcgaaccacttttgtgcgatgactaattttaattttggaggaaaagacatagtgaaaaccgttacggcaaaggcccatactaacattgcgttagttaaatattggggaaaaaaagatgcggcgctgatgctaccacaaaatgggagtatttcgctgacccttgatcacttctatacccagaccagtgtgaccttcgatgagcatctcgatactgaccaaatttactttaaccatcaacacttacccacgggcaaatcagcacgaatcagccagttcctcgaccttattcgccagcgcagtggtcaaaccaactatgcaacggtcaaaactgaaaatcatgtgccgacctcagctggcttagcctcttccgcctccggattcgcggccttagcaggggctgctagtcgtgcggctggcttacaactagatgcggctgatctatcacgactagcacgccgtggctcaggttctgcgacccgctcaatttttggcggttttgtcgaatggcatgccggccatgatgatcagagttcttacgcggaagtcttacaagacccggtcgattgggacattcaaatgatcgccgttgttttgaaggccaccaaaaagccaatcagctcaacggacggcatggcacgggtcgtcgcgacatccccctactatccagcttggatcaccacggctgagacggacttgaagcgaatgcgccaagccattgccgatcgtgatctcactactgttggccaaattgctgaaacgaacgcaatgcgaatgcacgcgcttaatttgagcgctgaacccgcctttaactacttcaccgcggatacactgacggctattcaagcagtcaacgacttgcgttcacacgggataaactgttattatactttggacgctggcccaaacgtcaaaatcatttgtgcgggtcaagataccgacaccattatgaccgggttacaacaacattttgacgctgatcaattaatcgtcgctaaaccaggtccaggtatcacgataacggaaaaataattcagtttaatttaaaatgatcagcgatggtcatgaaaggatatgatggcatgataacggtgaaagcccctggaaaactctacattgccggtgaatacgccgtagtggaaagtggttatccagcaattattgttgcactagatcaatttgtaacggcaacgatttcacctagcgaaacgattgggagcatcgtttctgagcagtatcaagaaaactcaatcgtctggcgacgtcagggagacgcgatggtttttgataatcgtgacaatcccttccattatattttagcagcgatcaatctcactgaaagttatgcccatgaattagggcgtgaacttggtgtttatcatctcggtatcaatagcgaactcgatagtgctgatggtaaaaaatacggtctcggctcttcagcagcagtgaccgtggcaaccgtcaaagcactatgtcagttttaccatttaccgatggataaaaataaactgttcaaattagccgcgattgcccatctatccgtgcaaggcaatggttcgcttggtgacattgctgccagcgtctatggtggctggatcgcctaccattcattcgatcggcaatggttacacctacaacaagctcagtcaagcttaagtgatttgttgacaatgccgtggcccgacctaaaaatcgagttactgacccctccagcagccttacgtttgatgattggttggacgggttcaccggcctccacatcacacttagtcgataaagtggctttagtcaaggcgaagcaacgcagcgaataccagacctttctaaaagccagcaaagcttgtctaaaacgtatgatcactggttttcatcacagtgacttgcacgtgattcaaaccgagttgcgaacgaatcgtcaactacttcagaaattgggcgatttcagtcacgtgacgattgaaacacccctgctgcagcgtatgattcaactcgccgaaagtgctggcgcggccgcaaagacttcgggcgctggtggtggtgactgtgggatcgttttgattgatcaaaccatcgacccacgaccattattaactgcgtgggctcacgatggtatcgaacaacttaacttaaacgtgcatacggttcaggataccgttttaccaaattcttaagcagtttattgacgagcctggcagccttgccggactcgttttcagattctaaattaattggaggtggcaccgtgccacaaagtcaacaatctcatcggaaagatgaacatgtttcgttagctgaaaagtattttcatggcgaacaagccaatgcctttgaccaggtccggattcgccacgacgcgttgccggaaactgccgtggccgacgtcgatttagccaccaccgttggccagtggcattgggacagccccctctacattgaagcgatgactgggggctcacagcgaacgggcgaaatcaacgctcgtttaggccgcatcgctgcagcttgtggcttaccgattgcgaccggctctcaaagtgtcgccatcaaagatccccaagtagcccccacttttgccacgatgcgtgaccacaatccgaacgggctgatctttggcaatcttggtgccggccacccgttatctgcggcccaaacagcgattgcaatgctccaggccgatgcgctcgagctccatctcaatgtcgttcaagaaatcgtcatgccagaaggcgatcgtgactttcattggctaactaacatttcggacttagtccaagccttaacggtaccagtgatcgtcaaagaagtgggctttggtatttcccgccccacgatgcaacagctctacgctgccggcgtacgctacctagatttaggcggtcacggtgggactaactttgtcgacattgagaatcgccgacgtgctaaccgcgatatggcctaccttcacgactttggcctcaccacggttgagtccttgctaggcgttcagaaccgaccggatgatctcacggtcttagctgctggtggcgttcgacagccactcgacatcttaaaagcgttgatgttaggcgctgacgcggtcggcatggctggcaccgtgctacacgctttactccatcatacggacgacgaagtcattgcgatgctgacggattggcagtcgcaattaaaacgcctatttgcactcgtcggcgtaacgcgtgttgatcaattcaaaagtagccgtattcaggacaagattctgttatcacctgaacttgttaactacaagcaatcgattaaagattaaaacaaagcgtgtcatcacaaactacggaatgtcattctatacttgtgatgacgcgtttttgttataaccaagtacaccaaaaaagcagtgtgcccctatggcaagcactgctttttgatcgtggtaaagaaaataatttccatcatctattgattgctattttgacacgtattggtagcggttcacgtacgtccgtggctgaccagcccgtagaacaacatcgccaaagccatgatgattaatagcatccggcaaggtttgcaattccacggccagcgcatggtagtcccctaaacgatacgactgcgttcgttcgggattagcggtaaagacaactaaaccattgcgatccgtgttgatgagcagtcgcccgtgagtcgttgccaacacgccaacgggttcatcctggtggtcaagcacatagcaatcatcgtattccgtcctgccagtttcttggatcaatcgatcgagctgcgattgaatcgttggctgctcacgaaagtcatacgctggtgacaggacgtagaagacgccggtcggaaccttctcgtgattcgtatgaactagcttggtcgagttgatacgtaattgctggggattaatcagtgcggcctgaccatcaagattaaagtaaacgtgacaggtcggattgaataacgtatcagcagtggtcaccccgtgatagctgatttgaacctcatcatcggccgttaacgtatagcttacagttaccgtcaagtcgcctggaaaaccatcgtcagcgctcgctagcgttgtcgtcaatgtgacagtgtcgccatcaggatcaaaacgagctcgaaaattatgcgtttgtaagccatgattgccaccgtgtagcaaatgccggccgttatttggttgtaagtgatacgtctgcccattcaaggaaaacgtcgcgttaccgattcggccagcaactcgacccactgttttgccgacttgataaggcgtctcgatataatccgccaagttatcaaagtgaagcactaatgagtgtggctggcggtcgacctgcacttcgaagtcataccacgttgccgcataactcaacacttttagtttgctatgatggatattttcaatcgtgtataaatagactgactcgccttgatacacaccaaatggtactgcagaaatcgtacgcctcattcccttcgatcagtgcggattgaactagttctgtgtcaatgtttgcgtggtaccatccacttgaacatcaatcggttccccagcaatcaacttcaaagtcgtcccatcgtgatcaaccgtgacttcaataatccgatcacggaagacctgacggaaagaatacttcgtccattgttttggtaagaacggccggtaactcagttgtccatcatgaacacgcatgccagcaaatccttggaccatcgcaatccaaccaccagtcattgaggtgatgtgaagaccgtcgaccgtatcattattgtaattgtcaagatcaagccgtgccgtccggttatagaaagccacagccttgtcttcatagtgtaagtcagcagctaacacggcatggatggctggtgacaagcttgattcgtgaaccgtcatcggttcgtagaaatcaaaattgtgtttcaattgtgtctttgagaaatcatcaataaagtcatacatcacttgtaacacatcaccttgcttgatataaggtgaccgtaagatgtggtcccatgaccaatgctgattaattggtaactggtcagctggaattgcggaaacgggcgctaaatccttatccagataaccatcatgttgaacaaagatatccagatccttgtcatatggtaaatacatccgatcaacgatatcttgccagtgggcacgttcttcagcagtcacgtttaaggccgctgcttggtcgtcactaacctgatctaaaatttcaagcgtgtacttcaacgtccattgcgccaaataattggtattaaagttattatcaacgttgttttcatattcatctgggccagtgaccccatgaatcatgtactgctgattacgtttgctgaagtgcacccggtctgcccagaaacgagaaatctccgtcaacactttactgccttcatgtaagacgtatgatgtatcaccggtataacgcgtgtagttataaatagcaaaggcaatgtcgccgttacgatggatttcctcgaaagtgatttcccactcgttgtggcattcaatcccattgaaggtcaccattgggaacaatgccccatcaagcccttgttgacgagcattatgataggcaccatccaactgcttataacgatacatcagtaagttgcgggtaacttctggtttggtaatccccaggtaaactggaacggcaaatgcttccgtatcccaataagtcgcaccaccatacttttcaccagtaaagccctttggtccaatattcaaccgtggatcatcaccataataagtactaaagagttcaaacaaattgaaacgcatgccttgttgggcctcggtatcgccttcaatttgaatatctgattgttgccaccgatcggcccagcccgcttcatgggccgccaataaatcatcgaaagattgggcgctgaccgtatctgtcagacgttgaagtgcagtcataatggcatcatcagtcggataatcccgcgacgtaaccacgacgacccgcttttcaaaactaacgctggccccagcttctaacgtaccgaagtagcgatcaaccgtggctgtatcagtcacttcggccgctttatgggttaaactcgttacataactaacttgcatcccagaggtaaactgtggggtcccaaaatcatttggtaccgtctgagcaattaaccgatcatccgtaacttcgtggacgttccagaaatgttcatcgtagttcgcatcttcgttcttaacgtcagcatccagtgcggaagcaacttttaattccaccgcttgatcgctcaagttttcaaacgtcaccttctgaacagaaagttctttttgcgcaacactcaagaaacgctcaaaggtcacgcgaacccgttgaccatcttgatcaacgataaatgatcgtgtcaaagtcccgtgttgcatatccaaatcaagtttaaaatcgctgaagttggcagttgccaagtcgatcttagtcccattgagtttgaaattgattttgatgaaattgacggcgttgataaccttgccaaagtattctggatagccattcttccaccagccaacccgggtcttgtctggataccagacaccgccaagataaataccgggaagcgtatccccagtataatcttcttcaaagaagccgcgcatgcccatgtaaccatttcctagactagtcattgattcttgcagccgtttgttttctggtttgaaatcagtcgtcaagacatgccatggattaacatcaaaaattcgtttcataagttaattcctcctagtttttgtacgtttctttgatcaaaccaactgtgcccgcacctactgcaaggacgatcccagcaaagatgaacatgttggcttgtgaattgccaaataatggatataatgcaaagctcaataaggacgcaacaatttgtggcaggcagattgagccgttaaagagacccaagtaagtccccatgtgttcgccagataaggcgttggttaccatcgtcaatggatacgtattcattgcggcccaggccatcccaaccagaataaatgagacgacaagtgctgattgactgtgaatgaagaaaattgagaagaagccaattgcaccaagtaataaactcaaagcataaccaagtttatgccgattattcggaaccttggctaaaacatatgaccaaacaaccgcggcaacggactgaacagcagataagatcccgtaccagttaccagcggcttggtagcctgcagaactggcattagtggtgtgccaaacgttggcagccattgcaccggttgagtatgtccataagtattgaaatgccatccagcagaagaattgaactaaggctactaaccagaaaacctttggtgctttcttcaagagtgccaaccagttaccaccagatttattagcgctttcatcaatgccgtgatacttcgcgtaagttacgggatcatattcccgcacccgggcaatcgtgataatcgttgaaaccactaagattgctgctccaatataaaatgaccagatcactgaattgggaataacacctttactagccgtattggcgaccccgaacaaggtcaacaggaatgggaagattgccgcaatgacggcaccagtattcaacaagaagctttgaatcccataggcgtaactcttttggtcatcgttgaccatatccccgaccatcatcttgaatggttgcattgcgacgttagacgataaatcaagaaatgccacggtaatcgcaccaaaaactaaggccgccatggaagcgtaaccaaatccaaacgagccagaattgggtagtagtaacatcacgattgccgcaacgactgttcccagaatcaagtaaggtaaccgtcgcccgcctaaacgtggggcccatgttcggtcggataaactcccaatgatcggttgaacgatcaaaccagcaaggggtggcaagatgaaaaaccagccaaggttatttggatccgcgcctaaagtttggaagatccggctcatctgtgagctctgaagtgtaaatgccatttgaacaccgagaaaacctagactcatcatccaaatcttattggatgacagtttcggtaatccggccgttgttttagatgtttctttcacaataaagcctcccaaaaataatatcaatcgcttgagtacaagttagattataaaaccgctttcaaaattatgcaagcgcttgcgtgaaattgcatgaaggcgttttacttattgacatccgttcctatttggcatgaaatcggctaacatcaagggctcagatagtattagcggatacattgattcatataaatttcacatataattcataaaaaagtcattatattgcatgctgttgcataaacaaatagatgcagtcgctgaaacgttgcgtgccgttgcactaataaaccgcttcagccgacggatatcattttgtaaataaataataattttcaataatcgattgtaaatcagtatcgctttccattacccgacactaattattcagttttaaagcgccaatacgccattttctggtcgaatattggcgcaaaaaaatcgtgtgttcaggccgacttagcataaacacacgatttcgaataattcagttattaatccgcattggcaatctttgcaaagccatcttgtaaatccgtattttgtgaactagtgaagttaaacgttgtggcagtggcactgtcttgcgagaccagaacgtctggcgaaccattatggaaaacatacagatacgtaatcacgccactagacgcgttcggatcagtggccgcggcaacgacctggtacttcgcatcggtatcagcagccgtcgtccacttgagcttgactgtgtcaccattgaccgtaatcttatcttggtactgattgtttttgatgtctgaaggtaaattcaactcaccaatagttaccgactgaccatcataagtcccctcgtacgattggttcatggtatcttgccatgacgacataaacgaggctaactcgctcgacttggttgtcgaccacaatgccgtctgagttgccgtactagcagatgccttggacgatgatgacgactcggctttttccgatgtagcagtgcgcgacgaagatttggccgtcgttgttgccgtcgaattactctgacgctgatgttccagccagtaatagccaccaccaagtgccacggctaataccacgatcaaaataacccaagacagttttgacgttgaacgtggttgcgcattttgacgcgcatgttgcgctgaacgggtgccaggttcaggtgcagtcggtgcagccgaaatcgatgtactggcgctcggtgcttctgaagcagccgttgacgacgtggattgagcagcagaacttacagatgacgccggtgttggttgcgctgaactggctgggataatcagccgcgcaccacaattttcacaaaataacgcgtcaatatcattctttttcccacaatttgggcaatacataaactcttcctccaatattacgattgattgggtccatttgaccatcaacttgcgtagatcgttcccccgattttaccacggatcgaatgattcatgacggccgctgctcatcacctgttcagcgtcaatcgcacgcggacgttatgacttagtcaatatcatgtcaggttagagcgtcgcgttttcagaggtcgccaagaaccgtaagcccttaggaaagaaatttttaaccgtcttggcgacgatttttccaaacccaactggcaacccatcacaagttaagacccgaaaaccagctacaggcgcacttgtcaattcaaatgtctcaccatggacatacaatgcccactgttcacgcgttatttcagttttgggtaaggacaaatcatcactcgctaaggctaacgcgtaacttggttcaaaccgtttcttcttaaacgttcccaataaaatcccggggcgaaagaccttgagctttcgcgtaacgggcatcatcgctggcacgccgtataactgatcaccatgtgcctgtaacacgagctgtggtaaaccggccattgcttgtttttttaaaaagtccgtccatagctgccgttgcgtggcgtttaactgttcgcgaaccacttttttgtccttgcccaccgtcgtgccatgatagaccaatttggcaataaagtgaccctcaccgcgcatcaagtgcggaaataaccgggccgctttagccagttcaggattgccatccgcccattccggctttgcatcgaccatcccagccgtcttggccagtggctccagctcaaactcaggataagtttttaacagccaggccatcatctgttcgtcctcttccggtgcaaaggtacaggtcgaataaatcaaatgtccacccggacgcaacatcttgaccgcttccgtcaaaatctcccgttggcgttcagcacacgccgctggatagtcgggcgtccaatactgaactgcgtcatgatccttacgaaacatcccttcacccgaacacggcgcatccaccaagatccggtcaaaaaagcctggcaattccttggcaagggcggcgggtgtatcgttggtaatcactgtattgcgggcgccgtagcgttccacattatcgccaagggcggtcacccgttgccgattgatctcatttgtcacgagtagaccggtctgatgcaagtagcttaacagatgcgtcgttttgccacccggtgccgcacataagtctaacactcgttcaccaggttctggttttgcaaactcgccaacggtcatggcacttggttcttgactgtagacggcaccagccaagtgttccagcgcattgccgttcaccttgccataatacccaattgggctatacggaacgggtgctgtcatcttggcgcgcatcgtggccgtcacagtcttgttcggattaatccgaaaccctttttcaacagggccatcgaaagctgccaaaaaagcgggcgcttgatcgcctagtagtcgttgatatttttgaataaattctgctggtaattgcacccaaatttcctcctcaattaaaaagcatcctcaattagattaccacattttgccccgactgtaaggtagcaaagattcgcaattaggtgagatttatgctaaattaaattaattaactgccggaaatatgggagatgtttgttgaatatggaaagaaaactaattgcgttagacttagacggaaccactttgaatgctgaatccaaactcaattcagcgacgatccaaacgatgcaacgactacaagcagcgggtcacattgttagcattattactggtcgctcatatcagggttcacaagcgatctatgaccagctgcgtctcaaaagcccaatgatcaactttaacggttctctgggccatttacctcaccaaacatgggcctcagaatatcagttcacgatcaacaaagcgattgtcttagcactcgttaaatatcgcgaacaattggggatcaatgaaattattgcagaaaataaaaacagtaccatgacagcgggtcaagatttgattgctggtcaattcttcccagagattgctgacagcccccgacttacaccagatacgttgactcgtaatccgaattccctcgtcttgctagtccagcttgatcggcgggctgccatcattgactggatcactgaacgctttggcgatcaagttgacgttggtgtttggggcggcccgaatgccatcctcgagattacctccaaaggcgtccacaaagccaagggtgtcgcctacttagcggattactttcaaatttcacggcgcaatatcatcgcctttggtgacgaacataacgacctcgagatgttcgcatacgcgggtctcggtgtggcaatggccaatggtactgacaagatcaaagcaacggctgacgatgtaacggcctataataatgatcaaaacggtgttgctcgttacttgaacgattattttgcaattgcggaataagttcggatgcaagtagtcgtcagttgtatcttaagttgctgactgcgcatcactattaattttcggactttacactagctcgtaatcaccactcaaaaatggcacttccagataaaattcaattctggaagtgccattttagttgttgttcaactatcaagggcttgcgttagctaagttcagtcacgctcttcaacggtcgaatcagccaccttcgaagctgatttagccgcagtatcagtcttagacagacgtttttcagccaaatatgagtgacgcataccatagctaaagtagatcactaagccgacgatgaaccacacgcccgcgtataattttgcctggatatctaagcccataaaaacgaacagtgcgcctagaaaggcaatagctggtaaaactggatagaacggcatcttaaaggctggtaccgcaatatcaacaccttcacgacgccgcaaagcatagattcccagcgagacaaacatgaaggcaatcagggttcccgctgaaatcaattgggccagaaaagcaaacgggcaaaacgccccaatgataatagcaacgattgttaacacaagtagcgcgttattaggttgattatgatgtaacttgccaagccacttaggtaacataccatcacgcccaaaggaataaattagccgtgaccctgctaaagtcatcccaatcagcgcagtaaacattcccagcacggcaatggcctgaataacactggcaacaatcggatggccagcttgtcgtaatgcccagccgactggttcggcgttattagcatatgatgaatatttgaacataccgactaagaccaaagcaacagccacaaagagcaccaccgcaatgacgagtgaaccaagaattcctcgtggcattgttttgccaggattcttagcttctgctgaattagcggcaatcgaatcaaacccaatataagctaagaaaatcatcgataccccggcataaattccttgccagcccccaaaagcactaccatcagcgtttaaatggtacttggggataaacgggacgtagttttgcacgtggatcgccgtcgcacccacgacgataaacgtgagtacggctaacactttcaacaccactaacacgttttcgacccgggaggccttactgattccacgtgagagcagtaacgagaccagcgcaatcaccaagacggcaatcaggtcgaccacgccaccatcagtcccaaacgtatttgacaaagccttcggtagagttagtcctaatggtgacaagagcccccgcagattggcggacagtcctgaaccgacgaatgccaacgcaataaagtactccgcaagcaacgcccaaccagcgatccaaccaaagaattcaccgaacattacgttgatccacgaataagcggaaccggcaaacggcatcgccgccgccatttcagcataagcaaatgcaaccaggccggcaacgatggctgcgacgatgaatgagaagactaccgcagggcccgcatggttcgcagccaccactccgggtaatgtaaaaattgacgttgaaacaatcgtccccacccctaaagccaagaagtccttgaccgtcaatactcgagctaggtgagaatctttgtcttcatatatgcttggatcttcctttaaagttaaccgttttaataaccgttgcatcaaaatcctccttattttaccaaccaatcttgcctcggggccgtttaaccagaccctgttcagcagcagccattgcctcatctaatacggttaacgcagtatctaattgcgtcttcgtgatgactagtggtggttggaaccgcaaaatatttcctttgagcgttatcatgacgacaccccgttcaaaagcggcataaatgacgtcactggcaaaatcaggattaggttgctgactctgccggtctgtcaccaattcaatgcccccgttcagcccgtacatccgtacctgcccaattttaggatggcgttgttgaagcgctaaaaactgttccttggcatagcggccataattggcggaacgggcaaccaactgttcatctgctagaacgtcgattgtcgccagcgccgccgcacaacaaaccggattggccgccgtcgtaaaggtgtgcgccggcgctgctagactctccatcacttcacggcgaccgatcactgcactaagtggtaatcccgaagccagtgatttgccaacggacattaagtccggtcggattcccgggaagttttgaatgctccacatcttcccggttcgtcccatcccttgattgacctcgtcgacggcaaataagataccgtgctggtgacaaaagtcatagactaattggacatactctgctggtgccttgcggataccgccatcaccttgaatcggttcaataatgacgcacgcggtttcctccgctggtaagtatgagtcaaatggtgccttgaacgcttcaaaatagcgtaatgcaagttcatgttccgtctcatgcggcaacgtacgataacaatcaggatacgggacgtgcacgatcccaggtagcaacggtcccatcttacggaccatattcaggctaactcctgagagtgacattgagccatacgttgaaccatgataggcatccgtataggcgactatgtattgtcggttagtataggcccgtgcaaatttaataatggcatcattggcatccgaaccagagttaccaaaaaccacctcattatcagtgccgggagctgattttgccagtcgctcagccaatcgttgttccggttgatgatgaaaatatgctggcgtgtaatgaatcaacttggctgcctgttcctgaatggccttaacaacgcgagggtgcgtatggcccacgttaatggccgaagcactggctaacaaatcgatgtattggttgccatcaacatcggtaagcagggccccgtgagcatggtcaataactaaatcatagtaattgattcgtgccgccgtcgccatataatggtcttcacgttcaataagttgctgatccaaacgatggttttgactaatcattcgcaagcctccattaatttaataagacttattttaatcatattttaatttctatgcaagtccttgcgcccatatttttgtttacaactacccgtctttaccagcatagccctagctttagcgctaatcaattttttaattaataagatgtaaattaaaaaaatcaccggttcattcaaccaattgctaacagcgaatcaacaagctgggatcattttaaattgtgaacgcgaccaccaaacttgccttgctggtcgccatcattttcctcagctcacctgctgcgcgcgaggtccgtggcgtgctagtgcacgttgggaatggatacgcgctcccacattgaacgacaccgctcagtgccacataagtggtacgaaaaaaagattatcatccgccccctatcaagggtcagacaacaatcgtttgtttactcagtctcactggccttaggttttaagtaagcggctaggccccaacagactagccctaagacggtcgttgccaccagcaaacgcaagctttctagattcagcccccgtacggaccaaggatggtaagtttgcatcatagtcggcaccgtggcggcctgcgctaactcgcacccggtcagccaacccgtaaaactcgcaatgatgattgccaacacgcggcaacgtgttaacgatctgattccgtcgtacttgacttgtaactgatagcgtgttttcatcgaaaaatcacttcctcgtgaattcgcgacctcgcggcaatttgattagcctgaatataacacgtgagcatcgtgccccccaaccgtcaagtaccattcacaaagtatctttacagtaagtaactgtcatcacgccgctttacattgtgaatgtaatcgtcgtcccccgggtcatcacgggctgctcgggtgctggtaacattcccgcttgaccagctttaagccgctgagctgctaagtgcgtaacggccgcatactgagtcgttgtgattggcaccgagcagattagctttgttcgtgactgctcaaattgataccactgtgcggcacgtaatggcactggatgccgctgtaaatcccccacatgaattttaaacgttgattgacgggtcacaattggggctggtagccagacccaccgtgttattgcttgtcccatctcaccaccaccgtttcgaatttgttaccgttattatagcatagcaaaacggaccgctgcgccccattaagggcatccaacggtccgaaaattcaatgttgttttttgtagcctgatttttctaaacgtttaacttgattttgtaaatgatcgaccttcgtcgtcaacgtgtcaattttaatcagtagttgtcgcagctcgtcatcatgctgtggttcctcgatcgtgacattctgactggcttgcgttgtgaagaagtcagtaatcgtactcgttaacaaaccaataaaaccaatcccaccgaacatcagcccgaccgcgatcactttgccaacggcagtatggggcgtatcgtcaccataacccacggtagtcgccgttgtgatggcccaccacagtgaatctgacaggctttgatgctcgaaaacggaaaagagcaacgcactaagaacaataatcgcaatactaattgaaaacaggtagataaacccggtgctatagataaagcggtgaaaatcgtgcgtccacttaccatccagtccgagcttccagaacaaatggtgatattggaccatccgtgccaaacgcccaagtcgaaagagtgcaaacaccgggtgcatgggaataatccccatcaaatcgaacgctgaatgaatgagaaaagtcttccgatctcgagaacgaattaggcgcacaaagtagtccaccgcaaacatgactaataagccgttactgatgcgggtttcaacgtgccaatcaccgatatgaaacgataataggatcacgttaactgctgaccagagtgtcaaaagtgtgacaattaagtgatacaccgcaattcttcgttgctgtcgctgttctgtttccatcctgcttacccctattttataaactggtaataatatagtccactttcataaaaataaccacgataagtgcgaaaaattaagtgagctttactaattcgttacaaccaagtccctaaaacaaatagcactgggtatagaatgaagaacagcgaggcactcttgaccgtcgtaataaacgtcttctttttatcttgcacctcaaagaacgggcgcataccttgccacataattggtagtaagagtacgacccaaatcgtaacaatgggtgctagtcccagtaagacgttcacgagcggccaaatgccaccaataactaaaaacgcttgaatcagccgtaccgaacctggtttaccaaggtagtaggccaaggtgtagcgatgattcaaaatatcttcatcacggtccgctgtgttattagccagttgtaggcaaaagaaaatcagggtcagtggtaaacatagtaagaaagtcgttccaacgatcgaccaagtcaacggatgctgtccatacatcgatacgaccacacaggtcaattcaattaaaaatgcaattgctaacgccacgaccgtctcacacagcggggtcgcgttgattggatagggcccagctgtgtaaaaaataccaatcacatagccaactaatccaaggacgagcactaaccacccagtccgcatgacaagccagattccgggaatcaatgaaatcaggtacaatcccaatgctaagcggccgacacccgctacgggtaactgcaagcgaccaatcggattcgtcttctgcgcatagccttcccgatcacgagcatgccgataatcataataattatcagaaacattgacggctaaatcaaaaataaatacgctaactaaacacagcgtcacgttaagccaattcaccgtacctaagtgatactgcgcaatggcgcttccgagaacaaaccacatgatattaagtggtgccgtataaatttctgtcagctcatagaatactggccaagttagccattttttaaacattttaacaactcccccaccggttatttaaatcgttaattatctattgggaccttattgaccatcgtcaccgtcgaagactttaactatcaaattttaacaaacttcacgcctaacgcaagcaaagcggatagatttaacaaaaaaattagggccagtatgcaaccggtcacttggaaatcccacgccacatgctggcacccctgctagccatcttcagaccagcgtaatgacttcatagcagccattaacatccttcaatgataagtataccgtaactaataaattcatactgcccattttagcactgatcctagtcaaacgttgccacaagcccttcgacgacagcagcagacctaaaaaagcatttcaagagcctaactcttgaaatgcttttgggtgactaatctacttggttttctccggcactgagagtgggaggtccagccgtgttaagtcagcatagctttcacgctgcacaacaagttgactatgtccctgttcacaaaaaacaacggcaggtcgtggattccgattgtagttgctagccatcgaataaccgtatgcaccggtatctaggaccgctaacacgtcgcctggtgcagtggccggtaattgctgattccagatcaacatatcacctgactcacagtatttaccagcaatcgaggctacctgttcagctggtaaggccggattcttggctaataccgcttcatacttggcctgatataaagctggccgaatattatcacccatacctccgtcaacagacaaatacttccgaatgcccggaatatccttctcatcgccaatcgtatacagggtcatcccagcggtagcgactaacgagcgtccaggctcgatccagatttctaacattggaacttgttgggctgcagtttgcgcgcgcgtttccttaataattgcatcgacaaaatcggttggctgcagcggatgatcttcggcagtgtacttcacgccaaaaccaccccccacattcatgatctgtgggtaaaaatcaagttcgcgttgccagcgagcaaactcactaacgagcttatcaacaatcatctcaaaaccattcacttcaaaaatctgtgacccaatgtgacaatgaatcccaaccagtttcaaatatggtgcggcttgcgcggctttgatagcctggtctgcttgcccactgtccaaatcaaatccaaacttagaatcggcctgaccagttgaaatgtaatcatgcgtatgcgctgagatccctggggcaatccgcaacataatcgtggtcggctgttgccgttgcgtcgtcaacgtcgtcagttgtcgtagttcaccgaaattatcgaccacgatggtaccaacaccggcatctaaggccatggttagctcggccagtgacttgttattaccgtgaaacgagacggcggccattgggaaatctgcttgttgggcggtatacagttcaccaccagaaaccacatcacaatgaatgtgttcttgggcgatcaattgatacatcgcgaccgttgcaaacgccttactagcataactgatttgatagtccacgtggttttcttcaaaaacttgcttgaatgctgcgatttcggcacgaattgcaccggtatcatagacatacagcggtgtttgatatttttttgcaagggtcaatgtatcgacgcccccgaccattaaatggtgcgccgaatttaatgcatccgtcttaatttgttcgttcacagtttaacctaccttctaaacttttaaaaaaagccggccacgtcatattcgaccggtccggcaatgaacaacctattctgcttcttcgtcgctctttaagacaccaccaacactatagcgatttttctgcatctcacttaaaatcacgtgaatgtgttctgctggtgcaccggtattcttgctgaccacgtcagtaacatctttcaccaagtttttaagttgttcttgtgaacgaccagcaattagatcaatgtgtacgattggcatgaggccacgctcctatcttaattcactattttcgaatgttttaatcttactttaatcttttctattttgcaagccacgacgttgttgatttaacggttcttttctaatgcccagcacgctgaccaattaaggctaccttgcaaaactaatcagaagcacaaaccgaaaacccccattgatgactaaacatgctaaaattaatttaacaaaaatgattatgccacgataccgccattgactgctcgtaccgtggagaaagaaggccccatatgttgactcatcagtttaatccttattccgcctgcactagtatcctagtgggtaaaaatgccagcgcggatggttcgaccatgattggccgtaatgaagattcacgcgccgcttgggcgaaaaaaatgattatccacgcgcaccgcgaattcgaagaaccacagaccttcaagtctcaggatcaaactcatccctttaccatgaccctgccaaagattcgtgcgaaatacacagccacccctgaatggactgccgaatatggcctgttcgaggaggatggcattaacgagtacggcgtggcaatgagtgctactgaaagtgcttactgtaatacacgcgtactggctgctgacccgtatgttaaggacggcatcggtgaagaagcaatggtcactgtcaccttaccgtacattcattctgctcgtgaaggcgttgaacgtctcgggcatattattgaagaacacggcacctacgaaactaacgggattctctttagtgatgtcaacgaagtttggtacatggaaactggtgctggtcattactgggtcgcacaacgaatcccggatgatgcctatgcagtcgttgctaaccagcttgcaatccaagaaatcgactttagtgaccatgacaattatctttatgctaaagacattcgtaattttgtattagacaatcagttagcttcaatggacaatggactgaatttccgggaagtcttcggtacggccgacctttctgatcgatattacaacacgcctcgcgtttggtatggtcaaagatgctttacaccaagtgtcacccagacgcctgagtcgtttgacttaccgttcattcaacgggcggatggcttaattcatattgaccaagtccaaggctacttagcgtcccattatcaaggcacaccgtttgatcccgtcggccagggcactgctacggagaaacatcagtatcggcccatcagtctcgccaagacgcaagaatcacacgtcttacaattgcgaccggaccttcccgtcacgctgagtgggattcactggctggcgatgggtgtagccgctgaaagtgtctacgttccattctatgccggtgctacgaccactccagcagcttatcaagttgctacagaaaaatacgatgctacctcagcatactggattttcaagcacgtcggtatcctagtcgacgcccactaccatgaactacacggggaattacaaacagtacaaaaggaattggcgattcaacttggtcaccacattattgtcacggatcagcaagttgccgctttgactggcgacgaactcgctatggcactgaccaaagccaatcaaaaagccgctgaccaggccttgaacacaatgcaagctctcgccgctgacctgataactaaaagcaccgatatgtcaccgttgaattacgatactgatttaaacctataaatcacaccccctatccgtttttgagggtaaccattattaatgtgccacggctttcggactggtcaaaatgcgcttagttccgttactatccaaataaaactcggtgcacgccgttagcctggcaatggtgtattttttcttagaaaccatcagcatgattatttctaagggaggttaccattgatgaccacgttaaagtatctacgccatagtatcttaattgcgtgttttttaaacttgatttttgccctgactcattgggccggcattgccagcgaccatctgttgatcgctacaaattacgggctcagcgccctgattattttaatggttttgttgaacacgatcgttttgacacatcatccgacaatcatgctcccccagcgacaacaaatttggctgatcaactttgctgccctactgattgcctttctgaccgagtggttatgagcattgtgcatattggttgcgttttgtcatcacttatcgcaaactaaggttaattcttatattaggaggcgctttttatgagtgatgttaacaagaagttcgatagcaagaaggaccagttgagcggcaaggccaaagaagtcgaaggtaaagtaaccggggaccgtgcacgtgaagcccagggcaaaacacaatccttaatgggcaaagctaaggacaaattagctgacgcagaagaaactgttaagggcgtcgtggatgaagctaaggataaaatgaagaagaaatctgacgattaaaatttgtcgtgggcacggcgcaaacggatggtgatcaaaatcaccatccgtttttttatgattacgccacttcaaatgagagcccccatcggcgcacacaaaaacaacttcgagtaagctagtacctcgaagtcacctgtggggcttgtttagggtgatgtttaacattttttgatgccgagcgtaacagccaggctgtcaattggcactgttcaattgtgttttgaccgtcgaacccgtgcccactgaaccacgaacatcattatcagaacgacggcaattgcaccgattgcggctggtatcacagtcattccggctaactcaggccccatcggccccagcacaccttcaccaatgagtgccccaagaacgccagcaataatgtgaccgatccaaccccgcgattgactggggctcatgatagcacctgcaaaagcaccaaccgccgcgccaacaatcattacccataaccaatgcatgctgtcatcccctttttagcggcggtgtttgaactgccgcacttctcgaaacacagtcaatcctaattgcccaattgcaatcaatagtgacaatttaccccaaaaaccaggggtctgtcgtttaattttagccattacggacacctccatcttttgataacgctaacaagtgctacttcaacaaatccttttatgcctaatcacaattactgcggctgaagcgcctgggcagcaacggttccgatcacaataagtatcatcgccccgctcacgactggcaacaacgtcattccagcaactgttggcccgaaccatccaaaagacagctggccaccaagtgcaccgaataagcctgcgattaaattaattgtcgtttgacgccgaccatgtgcgcctaccgcatttgcaacgatacctattgttagtcctaatatcgcaacacctatccatcccattgtgaacacgctccatcccgatattgtgtgattaaaattatcataactataatatttatattgagcaatcaaaatgctcattgacccgactaattcagtaatgatgcatatcatttccagtcaaactagtgttcaagctatactgagactatcaaaagcttactaaataagcgatgaataaacttaattttttaatcaagaggtgattgtcatggcaacaacttacggcattttctataacggacaagcgggtaatgggcaagcggcaaccgtcgcccatcaaaccgcgcaagcgctatcgaaccacggcattgagtctcaattactgacaacaccaggaatcccccgggcaattgcgttaattaagcaaacgcttcctcaactgtcagcactaattgttattggtggagatggcacactgaacgttgcaatgacagccctaatccaagctgaagcacatattcgtatcggcgttattcccatgggaacggttaataattttgccacccgctaccagttaccaactgacccccaagcggccatcgaactaatttgtactcagccggcgacccaagcagtcggcatgctagtttgtaatcaacgccgggcagtcgtgagttcactgacattcggtaatttggctgacatttccaatgaagttcgacaatctgagaagcagcgattcggtaaattaagctatctttaccgtgctattcgccatattggtcacaataagtcactgccaattcgatatcaattcaaacacgaaggaagccacaccttaaaaacatggttctgtttgattacaacgaccaaatcagtcggtggacacgtctatagcgcgtctgctccaggaaaaatgcatattagtctacttaacaacattggctggcggcaagtaattccatatttttggttcgcactaacggggaacttgcaaaactccaaggccattacacagctaacggcaaccagtgcacgaattacgagtgcaactggtcaagccgtgacgacacgtattgacggcgacccagcggttaaactaccaattgaattgacctatttgacggaccgcttcgaattgatcgtaccagcagtcatcgaataacgacgtattttttattaatataatcaacatattgattgcgtactattaactttttgattatagttaaacatagttattaattaatcccaattaacacagggaaaaaataataatgttcacatcataactttattggggggattacgatggcatctgcttatcgcaaattttgggacaatcttttaaacttttcgggtacagcaacacgctctgagtactggtggcccgttatcattaactacattcttggtggtattatcattgcaattattcagatgattatgggacaccccatcgaggatatttacaattggagcgatctgagtgttaatacgatgagtaaactcatcgcattaatcgtttggttaggaacactctcgttgaagtttcggcgattgcatgacagtgatcacactgcatggtggattttaattgacttagttccaataattgggaccatttggttcttcatcttaatggtgttgccgtcacgctcaaatcgttggcaataatttaactaggcgcaacttttattggctaagcggcccataatggttgcgccttttgtgactgagcgctggcagttaatcatattaatagacgcactaattatgtgaatgttatcattaatataataaataacatcatttcatttaggaggtcctgaggatgtatcaaaatattctagtcccgcttgatggctctgataatgcctacatggctttaaaacacgcggtcaaactagcccagacgtttaaatctaaattatttctggtcaatgttattgatattacacgcctgaatgcgtatagtcctgcagcttacgggggaacgctatatacaaaccttctaaaagtcgcaaaagataatagtcaggacattctggatcgtggtcagcaaatggcttcggcagcacaagtcgaatccctaccaattcaagttaatagttcaccaaaagctagcattgcaactgatattccccaaaaatatgcaattgatctaatcgtcatgggcaaatccggcaccaacgcggtttctcgaattttgctaggctcaacaaccgcgtacgtcgtacaaaaagcggaagtcaacgtgacagtcattaacacaattgacgaccctgattagacgactaatagaaggaaggaaaaatcaatgatcaaagaacgccctaaattcaattggcttcatctgctcattttcattgtggtcgtcgaagcaatcggtggtctgtcggcatggctcgcgggagacattaaggccgtttacaatgggctcaacttgccagtactatcaccaccagatggcctctttggcatcgtttggccgatcctatatgcgctgattgcgattgctggttacttagttttccagcaggctacgacacaccgtgaccgcctcatggatgccaccctgtttggtatccagctgttactaaactttatttggagcatcatctttttcaaccagtcggcttattggtggggcttagtcattatcattgtgcttgatttagtcgtcttactttgcatattacagttctatcgcagtagtcggctagccgcaattttgatggtcccctacttggtctggatctgttttgcaacttatttgacattaggcgtcgcattattaaattaaatataatcgcaaatcaaataacggtcccatcagtcattgttactgatgggaccgttatcttattgtattaaagttttaacgcggcttaactggtgttgtcaccgccagggccccgtgtatcggcactgattaccaatcaactatttaaagcgttctacgttgccgttttcttgaacgatacggcacagcgtaatcttgtggcgcatcttccggactggcactcgtccaatggccactaccctttttagctgggcgggcatcatctttgagacacgtaaaccgtgagccgtgtttatcctggataataaaaattcgactaaattcgttgatggtatcgactaccgtacaatccgtatgcttgatgttgaacacatccgtataaactttactcattattgtccaccccctaggaattagtatttaacattgttaatataccgcgtcttgaatgacaaatccataaatatacatctgctggttattattactaaaaaatgataatcgtacaggtcactgataccccgatataccgcctaattcgtttaaattttcgcccgcatcaatcggccttgataaatgagtaattaatcagatgcagttgcataattgatacctgttttcattgtaaaatcctggtctcgtacgatataatcagaatattctttttgtaagattattacagtaagatggtgacgactagtcgcttcaatgctttggcggctttatcggcatcaccgagtaggttatcagtccgcaagcacgaacaacagggggagtattcaatgaaagtcattaatgtcgcactacacgtcaagcctgagttaaccactcagtatgaagcctttattcatgagctagtggtcaattcatcacaagaacccggcaacggtttctacggccacttcaaacaactaggtcatgaccatgactacgagattattgagcactggcaagaccaagccgccgtggatttccataataaaacaccgcacttccagaactttctcgctcatatcaacgagtatctaataactgagcctgaaattacccggatggatcactaacgacttggtactgtagtcacatgagcgcaactgacagtcacctattgaatcacaaatttgagccaccttggttcaactaacttgcattgaggggatgctcctgcgcgtactccttaatgctaaaatgccagctgccaagctgtaatcgcaaatctgattcccggcatccgcttaattattaccactaatttacaatagcaacctgttcttcactaatcagtaaagaccggtcatcgccattcgcttctatgaatccttaaagcacatttaaaaaggtcttactagccaataaacgccagtaagacctttacgatatctcaaagacaacttttatagtctaaaatcacctcaaagtaaatttaggcctcatctaattactgtacgtcaatatctgagacttgatagaacgcattaccagtatccgctatattccaaacactgagtaacacttgatagcctttttcattagcagaaatattgacttgatgggttacaaattcactagggatggcaccattgtcattataactagctatcttcttgaaatcactaaacttaagtggtgcgtttggattccagccaggcttggtaatatagtaatcccaagtactagttttatgacgagcagttaactgccaagtcacactaagattgccggccttcacaggtgtcttataccaccgtttggcattttgctcgtccagtggtgcaaagttagcaataccggcactggcaattttgccatcaataaatgtattttggggcgcttcaatactctgtggttcatacataaccgaaccaatattggtattcaaaggcccacctggataccaagtactccccagataagctctgccacccgggttcgtcacaaagccatgtgctgaaacttgaatcacgccacaacctaaaaacgcgatcatcataccaactataataaataagtaccgtaatacatgattcttcttggtgctcaacataagatcccctcctcaattgtcactataacgccctgacaacatgatagccaccaagatgcacagaggcccgaaatcttttctatgcctatcgattccagcctaatactgaacaagtctggaatggttgcccttgtctatcattccagatccataataaaaaatccctcatgtttttatgagggatcaatgaaactacatgtttattgtggagctatatttcgatacgactaccgcagaaccgacaagatcaatcataaatataatggcgagtcatcggaaggccagttccactcggcgctttcactaatagatattgaataacatcgatatttccggcctcaaaagcagctgcacatgcctgtaaatataattgccacatgcggtcaaatcgttccccataattcttgacgacctgttgttcgacctgctgataattgtgataccagatttctaacgtcttttggtaatggcgccgcaagggttcaatgtctgaaaattgtaacttagcagccataatatgtttgagattctcagcaacatttgggatatagccccctgggaaaatatattggttaataaatggatcaacgccggcaccttcatgttgacctgtaatgccatgaattaaagctcgacctcctggaactaagaacgcttgaattttattaaagtacaaccctagattttctttaccaacatgttcaaacatacctaccgaggtgacataatcaaattggccagtgacttctcgatagtcctttaactgcacatgcactttttcctccaaatgacgttgcttgatttgcgcttgtgtataatcatactgttcttgacttaaagtaatacccgttgcatctaacccaaactcatccgcggccataaataataatgttccccaaccactcccaacatccaataatcttttaccaggctgggttgccagcttatttaaaatatgtctcactttattgagttgtgcctgttttaaagtatcatcgtcatgttcaaagtacgcacaagagtaggtcatggtatcatctaaccatagtttataaaaatcattgccgatatcataatgactttgaatatcttttgtactgcttttttcggaatgtgatatttttggcaagtgtttcaaaaatgaattatgtgtcaaaaaactgtctttttggcggtaagcagaggcaattaattcctgaatgctcccgtctacttcaatatccccattcatgtatgcttcacctaaaaccaatgttggctgattagttaatagcttaattgggatttctttatttaatcgaactttaacagctggcatgccggtaccataccgttcaatttgcccatcccaataagtgacttcaatagtaatatcgaacgctttactaaataagtttttataaatgattttgtctagcataacagtctcctatataatgttttgtgtatgaaacattatatacctgaatttgattttctggaagattgattgtctttatttcactgaacctgtattgaaccgcaaacggtatttctaataatagcaatgattgtcagttttatttatactgaaaattatgctgttcataatatttatattgataatcttaaactactaatgttaaattcagaatgacctattttttaaataccaagaactaaggtctgttgccaaacatcgagattgttcagcatcaatatttactgcagtcattacatctaaattgcttaaactaaatggagggattacaaatggatttcattatcgcaattggcggcctcgtcactggcattggcctcatcatcaatgtctttaacacccggatcaagtatggctggttcactcactatcagagcaaaagtcggccacttaattatgttagtttattattaatcataatagggttaattattattattggcaaagcctatctaaacggacaactaaattaacataaaaactaaattgctgatgcagtacagtattcatttgtatgttagcctatatagtagtaacgtgaagtctatatcatttataactaattcatttattcaaactaaacactacactgggggattcaatgatgaaacagcaacagaaattagcgcgtttaacaactgttaatcagcttttagaacagctaaacacttcagttccaattgaaaaagttgaaatcagaaaattaattagccaagcctacgcaactatcaaccaaccagattcagttactaagcgttatcaacaaatacccgacgcaatcaatgaattaatcggtcaacttcaagtgatggctgtcgctaaaaaataccatttctcatctgaacaagatcagttaattgccaacttaacaacttctacaaataaaatgtttgcccacggttggtatggcctaattgccatgagcggtgttggaaagtaaccctagcaattcataaagagtgttccagctacgatttgacccattgaaggcatccccaaaaggagcatctttttaaaagattagcgggtcatgatgtcaatttttgttactgtttgaactcaactgtagtataaaaggcgctcatttgctgagcgccttttatgttactgctacaactttgattgttgttgtatcaacgttcctacttgacttccgaagtattcacaattggctgagtacctgcccagaaataatggtgaccatctagcctttttctattactaggttttactgcctttacaaggcaccctaaacaggctctttttacaattttggattgattgtttttctatttcaacatgatttcttcaccacaaaataaaaatgaaatacgagtcaacttgcataactgatagatgtcggacctcacccggcagaaatttctcttttttcttgattttctactacccgagaactatccgtctatgcccacatctaaaccgcgtggatattttgaaattattcatcgactttacacgtcataacgtgtaaagtgattgatgtactaaagaggaggtgattaaatttccccgtcatatgaaaaagaagcccattcatatcaagttagaatttgcggttcacttgataatcatagacttcaaaatttcgattgattggtaattctttcacggagggcgctcgcccgccctctttattacacttttattatagcaaaggagtgagcaaaatgaaactcatcaacatccatcgcaaacatattaatgtggaacttgaactgaatttgcgtgactggaaagatgcaatactttggggattgttggctgtaatcgtgattgttactatctattgggtggtgaaattataatgggtgaaaaactaagtgaggcacgcattaaggctaataaaaaatgggacgagaaaaataaggaaagaaaaaaatacattgtcaaacgttctacggctaaaggcttcattcgagactatgctactgatgatgatctgacagaattacttacgcttatctcggatagacataattttttacataaaaaaattaaagataacaacaaatagctacacattgattaaatggagaaattaatggttcttgattaataggttcaagtgctgctatgatctcattaattgttacctagttaaagttggcctctttgagaaaaccaacataaccatcaattaaaagagtcattagcaacctacatacataaatggcatgataccatgtcatttatacatgtaggcagttatcgtggccgaatacaataaacaccacgttggcttaactgttaaggtttcagcgtctaaaatcagcgatagtatatctctaacactcatgataagtcactatcagagatgagataagagtagctctttaaggagggagaaatttgctattattgggattggcagtgttagttgagtttatcttactcacatatgtcattaagattcaaaaaagaattatgaactataccagatcggacgagctatatttttggggactttttctaagaaagaacgactcccgtcgcaaaattaggcagctcaagaaaaaagttcttcaaacgtatcgtagaagttccctaaaaaacgaactactcttctggttagaatttacagttgctaaatgttgtttttatggttcacttatatggagcttttacgtaattgctttcggaaatagcagaaccccattctggccagccattataggctttataatggcaattccacctgcaatagcacttccccaacaactgtatgatttttggagacaacaacctatttggcatgagcatcccattgaaaaacaagcttttctactaccaaacgaacaggaccacaaagatttagttaggtaccatttgaaatcctattccgcattgttcgtaatggcaattataggatttctagtataggaatctgagcgttaaaaaagacaaggtgagaaactaattttggtttctcatcttgttcatttttcatctaaatttttctttaacctatactttattatttgttaagaaatttgtagcaagcgctaaaaatgttgcggcaacacccgtaacaggcgatgaactagcaactacaactccgattgaaataactgcggccatcacaaacatagctcttactgttttctcaagtgattctgcaggatcataggtaggccagttttcaaagtcgcttttattgaaagtaacattaatttcaattgttatggtctcacttaatgagcctttttcgacttgatagacataatatttcaacttaaagttaaactcaccgttcttgatatcaccaatttctaactcaaaattttctttttttcagtgaagttgaaagcaaaataaatagtttgtcaaaaaaggcgacagcatgaaatgttgaaaactgaagaagcctccaaaaatgcgatagtaatgccattctttgccgctctaaattacaatgtctttgatcctatttaattcgttcctgaatacacaacagattttggtagtaaaaagcgttggcaatttatggcttatcaaggcatggatactggaaccggtaagcaaaaaccagtacaccggcaaggatttaaaccaagcgagcagcccaagatgctgctaagctaattgaggccgaagctgtggctaacaaccgattatcgaatagcaaggccaacatgacactgggcgagtatctgatgtactggatcgataacttaaaagtaaatgtaaaggtggataccattcaaatccatcgtcggaatatcagattctacatcaatccccgaattggtgattaccagcttaaagattattcgtttaatgttcatcagaaatttatcaataaccttttcatggaagaaggagctggacgttctaaacatggatatggttggaacacagtccagtccatcaatcagacgctctcaaacgccctagagaaagctgtacgcttagattacatcaaagttaaccctactcgacatgtagaattcaatcgcaagtatcgtcacgaggttagaaaaatgcgctatttcactaaggaacaaaccgataaatttttataggccgctcagttggaacatctatcattgtggtacccctttttcctactcatgttcgactgtggcttacgagttggagaagatctggctcttagatggtcacgagtagacttcaagcattgcataatcagtatcgacaccattcgcatttataactctgaagttaaggtaaatgacattggattaaaagatatgatgctagacacgcccaaaacgacaaaaagtattcggaagattcctttaacagattgcgcctatgatgcactaccggatctatttaaacaaactcatccaaatgaaataattaagctcaatcggtctgatattgacttgaatgacttcatctttatcaagcccacgggaaagtttcacggttaccctctggccattacttctgcacaagttgccatgcccagaatctgtgatcgtgcgggtattcctcgtttaaacgttcatgggtgtcgtcacacttatggtgtacgattacgcgaagctggcgtagatattaacgacattcaagacttaatgggacacgttgattcagagaccaccaaattgtacgcggaaatcacgccaaaaattaaggaagacgcagtaaaaaaactgaatacatttttaaactaaatttactgaaattcatcgtttttaacaaaaagattgccaaaacattacggcactcgttacggaaaaaaaggcaagccttaaaaaataaggctcgccttgattgttattatcttatagatgttgttatatcaacgttcctacttaacttccgaagtattcacaatcggctgcgtaccccgctccgaaataatggtgaccatcatgttattgatcagttgcagtttcttatcgtctgatagctgcatccccgtatctttctctaaacgggcgatcgtgtcttccgtgattgaaacggccccttccacgatgaccttgcgagcagatagaattgccgaagattgttggcgttgtaacatcgcactggcgatttcagtcgcgtatgcgagatgcgttaagcgcgtctcaacgatctcgacccccgcaacatttagccgttcttgaagttcttccattaaccggtcagaaacttcggttggattgctccgcagcgtaatcttcttgtcgtcatcaaacgtatcatatggatattcagaggccacgtgccgcaccgctgattcactttgaatctcaacaaattgttcataatcatccactgcaaagagtgccatactggtatcaacaactttaaacacgataacggccgcaatttccacgggatttccccggaggtcattaacttttaaaatggcactgttaaagttgcggacccgcagtgaaatggaaaacttactggttaacggaacggtcataaacagccctgaatcacgaattgtcccgatatacttaccaaaaaatgttaacacgcgcgcctcgttggggcccacaattgttagcgaactagccccaaaggccgcaataataattagcaatgcgcccaaaaagatactcgcaaaatgatcgccagtcgcaccggcccaaaccagccaaccgccaactaacacaaatgcgatcgctaacactagaccaatatagccattgatatgaaacacttgtttttctttcatcaagactaccccctttggcccttattatagcataagcgcctcacatgctcgcaaatctaagttcgatggcaagttccaaagtcagtggtggcaatcaccttcgcggccctcccggctcagctattcaaacgtgcctgaagtccatccccatcaacgtgacttaactcggcttgccacttttccgctcccgtcccgcaaaacaccaggtcgtcatcactagcaatagtgtgaatggccaagcgacttggtaggggcgcataaacgcagcagttaactcaattttggttttggccttaatcgctgatgcagcagtccttattcgctgattagtgtgtttaacttgactgtgaaccttttgggccacctgctgatgaatttgagctttgatacgcactggagcggactgcaatgaccgtgcttttaacacttgcatataattggcagcaaccaaccggcgggccttagccgccgtgattggctcgtggaccgtttgcgcggtttgctcagttgctaattggtggtcaaccacgcgtaacgtatcacgtttggcttgcttaggaattgataaagtagtgaccgtcgtcgttgcatacgttcgtatctgtgtcttagccgttgtcaaattagcggctaaagctgacacaaaaatggctacggccaacgatgtgccaatttgccgaaacacgccaatcacactttgtgacgctgtcagtaactcaccggtaaaatcaccggccgctaataccgtaattggcccaataatcgtgccgtagcccgcaccaaccagtaacgccgccaatgcaaactgccagtactgactaggactcatcaagctaagtaccccataacccgtagctattgcgagactaccactaaagatcacgcgccgcgcaccaagctttgctaacaagaaaccactgattggtgaaaaaataaaaatcatcattgaagcgggcgtaatcataatcgccgccatcaattccgtcttactttgaactttcgtgaagaaactcggcatcaagactaatagtcccaccataaagacccctgataacacggtcgctaacgccgcaccgttaaactgtcggtctttaaatagggctaatgggaccatcggcgctgagacgtgggcctccatccagacaaaggcaatcaatgttagcgcactagtgacgcccaggctcaggactacgcgactcgtccatccccagtcattacctttaaccaggaccaacgtcaatgccaataaggtcgtcatcactaaggcactcccaccgaggtctagttttacttgaccatgactagggtgccgccatgatagccaggcgatgcaaccacacaacgcgacggcaactaaaggcacgttaatcaggaaaattccccgccacccccaaaattgagtgaccgcaccaccaatggttggtcctaacgctgcggctagcccttgcagcacgcccaagcttgcaatgacccccgtacgcctgctgagtgcaacactctgaataccaatcgtcatactagccgggaagacgatggccgcaccaatactttgaatcgctcggccagtaatcagcagcccgacactgagactcaatccagaagttagtgaaccaataccaaagagcccgagtccaatcaagtacatccgcccacgtccccagacatccgctaaccgaccgagtggaatcgccagactagcaaacaggacggtgtaaatattcagtgcccacgacaggtgcgtcaaatcagtatttagtcccgtctgaattgctggcaacgcaatattcataaccgtcgtatcaagcatacatagaaaaatgccaatcatcatcattgcaattactttcgtcgattttttcatcataatcgcctcccgttaagttaatgggagtatatctggtaaaatggtcataaataaatacttacgttacaaaaaaggagatgttgtaaccaatggacccacaaacacgaaaacgccaaaatttaactgcggtttatgcggccttactacagcttatgtcgcaaaaaccactcagtcgtatttcaatcacagaactttgtcagcacgctcaggtttctcgcacctatttttaccgtaatttcgccaacttcgatcagattatttgggcctatcaaaaacagactatccttcaatatctgcgccaattaccgcgacaatcaaaggttaaattgcaggtattgatgactcaatatttcactctcatgcaacaaatggcagcgacaaatgcgttattgatcaaaaacgaaaaagcccagatttttattcaaagtttcgaagccgtctttgcattactcattaaacaagaccgtattatcggttcaagcaataccgcgcttcgccaaccgtactacacggcttatttttctggtgcggtcatcaatatgctcgttcattggcaacagaatgggatggttgaaacaccggcctatctcgctcaacaggtcactcggttcactctacgcgataacgaaagtaggtcctaaataaaacggggtgccgttgccgacatcccgtttagtagcttctttaatttacttatcaactcagtcgcgatggtaacgttgtttaacacgcttcatcgcttgtttgccaccgaacatccgctgaattttagcctgctccaactggcgtgaattgagtccttgatagctcatttcacgttgtaatttttgatagctttgtaaccgttcagacgttatcgtgcccacctcaactgctgcccgtaccgcacaaccaggctcgctagtatgggtacaatcattaaacttacactgtgtcgccaatgcggcaatttccgcgaaagtttgatttaaatcacccatgaagatttgtaactcacgcattcctggtgtatcaatgacacaggcgcccgttggtagcggtattaattgccgactcgtcgttgtgtgccgccctttgtcatcatctgtacgaatcgatttcgtcgccaagatatcctggcccaacaatcggttaatcaaagtcgacttaccgacacccgaagagcccacgaaggccaccgtttgaccagtcgttaggtatggttgcaattcatccaaaccctgacccgtttcgaccgaacaagtgatcgttggtacgccgacactgacatccgccacagcccgtaacttagtggctagatccgtgcagagatccgccttggttaagacaatgaccggaagtgcaccgctatcccacgcaatcgtcaggtaacgttctaaccgccgcacattaaaatccgcgttcaatgacatgcagataaagatggtattaatatttgtcgcaatgatttggccgtcttggcggttcacggcaccgcgcgccaagacactctgccgtggcgcgattgcttcaatctgcgcctgattatcagcggatgaagataggcacacccaatccccaaccgccggaaatgccgcgggactggccgcttcataagccagttttcccgtaacttgtgctgaacgttccccagccgtcgtgatgacttggtaccaatcacgatgttggccgataatccggccaagtatttgaccgttttccttagtcaagtcggcttgaaccgccgtcgtcaatccatatttaattaaattaattgtcaatttttataatcctttcgcaaagtgacttaccctaacgctctgcgaattaaaaatgcgcacagtcttatcccaactgtgcgcaaaaaccgtccggcatgtctatctgccaggccattcgtcacattagggtacacgaaactaagcgggtccaacccacttttttcgctcaacaacaccctaacgaatgcccgacataaaacacccctcctatatttgataattacaatttaacaagtctcaccaaaattgtcaatttaaatcgattcaccacggcaattcaacgctaatgtgcgcattaaagtcttgctggcgctttagtttggctaaccgggcggcctgccgctcttgatagccctgagcaacaaacgtgtattctggtttatcagcgactaacagtggtaattcaatattacggtccgtcaccacgaacgttgaaaagcaagtcaatcccaaaaaccgttcgccggtcttcaagtgttcaccaatgattttagtaaatacctcgattgagcggtgaccaacgcccgaaacgtaagattccgcacacattgagtcttgtaaccgaaacggcaataaaaaattgacctgatcgactgacacggtcaccgtctcaattcgagccactcgcgatgcggcaatcgatgaattatcatcgatagtcgccaagatttttccgccaaaaaccgtgtcgtgctcattcaaatcagctgaaaacacacggtgattggtaattgataaagtctgtgaaatatgaattggttccatgtctgcaccccgtcatctttaattatttttatttatatcactgcaaacgacctacaatgtgattaaaacagactaactagctcggttgttgttcggacacgtccttcctgctacgaccaccgaaaccgactgcttttatccttatgtcatcgtcggctttgattccgattcaagacacatcgttagaatgtgatcagccgccacaattaatctgaaagtgattggctatacttcgtcgcaaacgcccaaaatttagcaaccacggcagcgtgattatctggacgtttcatgaaagccatctgactgcgaatagtaggcgtcagtggaattgctttaatgttgtcaaaaccagtgagatcaaatgaccgcgccatgacaaccgagacaccatcaccctgattcagcatttctaaaatgagatcaattcgttgaccatcatagaccatctgtggcgtatgcattttttgaaatgccgaaaacaacgggttatcttcaccgatggtatctttcaataataaaattgattcatgtgccagcatcgacagactaatctcagcttgttgcgccaacggatcgtctttcggaacaaggaccacaaactgatcggtctcattcaataaaacgtcataattattgggttgatccccgaaaatccgtgtaaatacaatgtcgacattcgtatgatccagtgcatgcgctaactgatcgacactcgcctcactaaattgtaatttcacttccggataccgcttcgtaaatgccgtgataatatgaaaagcctggtattgtgctaaagatggtagtccctgaacaaccagcgactgcgcattatgagcggtattagcggccagaacttgttgtaactgacgctcttcgcgcagaattgcttgggcccgtggcaataattgttgcccaatccgtgttaacgtgacttgccgatgcgcacgttcaaataattggacctgccaatcgcgctctaaagccataatgtactttgaaatggtcgactgtgacaaaaacatgcgttcagcactgcgactatagttctgggtcgtggcaaggtcaacaaacactgccaatttccgtgtttccataattaaccctcttctaactattcccatttagaatagtttaccacatattcagaattgttcttatccgaaacaagctctaaactaatagctgttgtttttatcaattaaatattgaggagggcttgcgtgccaattggaattattactaacgtgtgtgcaatctttttcgggggtattgtcggcgcattgaccggcaaacgaatgtcacaacgtttaaaagatgggctgaatatgtcctttgggatctgttccatgtgtatggggatttacgcgattgcaccactaaaaaatctagcggcggtcatctttgccgttattatcggaacaggtattggattactttgtcatttgggaactgcaatcaatcacggcgctgccgcgatgcaacgtttcatttcacggtttgtcaaagcaccagcaacttttgagaaacaggcttttgaacagacaatggtcacggtaatcgtactattttgtgccagtggaactggtatttacgggactttaactgaagggatgaacggcgacgccacaattttgatttccaaatcgattctggacttctttgctgcggtaattttcggtgctaacttagggttagttgtttccttaattgctgttccccaactaatcatcctgactgctttattcttaatcgctcacctagtctttcccttgaccactcctgacatgattctagatttcaaagcggtcggtggtattttaatggttgccagcggctttcgcattattgccgtcaagatgtttccgaccgccgatatgattccgatgatggtcgttatcatgccgatttcatggttatggatgaattttgtattgccattattatagataaattattgaaggacaaattaaaaagcagttctgagcccacaattatggcttgctcagaactgcttttagtcagcacgtagaaggcttgcaatagcaggtcaacccagtcggccgataataaaatccagtggccattgttcactaaacttaaaaaagaacgcactaaagttaataccaacaacacgctccaatcagccaaccgacaagggacgagccaaaaatccctcgtgagtcgcaggcaattctaacggcgtcaactggtataactgtgtttgatagcacgctagtccacgttctaaatcaagaacctcaacacggctgggcgcatgggtcaaaccacagcccactaactttaataccgcttctttagccgtccaaagttgccaccctaaccgataacgatcttgcaccgataaagcctgtaatagctgccattccgccgatgtaaaggctcgccgaatggcagtcacatcatatggacggacctgttcaacatcaatccccagaggtcccggaccaaccgctaccatcactaactggtgcgtgtgactaacactaacacctaatcgaggatgacttggaaaatagggctggcccaatcgatgataagctaatggtaccgataacacttgctgaattaattggcgactcacggttcgctgagtgacccgtcgcatttttttagaaacatcgaccggcatctgaagccactgccgtttaaagacaacttgagtgattggcattaacttaagtggacccctttatccacgtataccacgtccccggtcattccagtcgagagatcgcttaataaaaaggcagccacgttgccgatctcacgcgtttttaccggttctccatcaactgtcatactgcgagataattttaataattgctgatgctcatgaatacccgttaccgccaacgttttgactgctccggctgaaattgcattcacgcggacttgttgtggtccaaggtcacgtgccaagtaacgcacatttgcttccaacgcggccttagcaacccccatcatattgtaatttggtacggctcgctctgatccaaaatacgtcaacgttacgagactggctcctggtttcagcattggccgagctgctcgggcaactgcaatcagcgaatacgcactaatattttgtgccaaatcatatccagctttcgtggtattcacaaaatcaccttctaacgttgctttatccgcataagcaatcgcatggataatcccatcgatggcaccatactgttgtttaatgcttgcaaatgcccgatcaacattgtcatcatcagcaacatcacaggcaattaacggcacatctggcgcaacaaaccgctgtaaactttgcttcaaacggtcattttggtaagtcaagataacctgggccccctgtgcaattaatgcctcggtacacccccaggcaatactgcgctgattggccacacccatgaccacaatagtcttacccgataaaattccatccatacttatcattcctcacttatttaaaattgccgataacgggcttggcgttgcgtaaccagttccgtcaccgactttgctgttaaagcagttaatgtctcgtcaatggccgttttcagcggttgacaatctgctgcggttgctacttcaggaataatccgatcaataattccatctgccaataattctgtcggcgtcaagcgcattttttccgcagcttcagcagcacgttgcgattctttccataaaatagtggcatagccttcaggcgataacaccgagtaagtactattcgccaacatccagacttgatcaccacatgctaaggctaatgcaccaccactgccaccttcaccaacaatcaaactcaaaaatggtactcgcaattgtaatcctgctaacaaacagtcagcaattgctcgtccttgtccctcatattccgcatcgacacccggataggcacccggcgtgttgattaaggtcacgaccggctgccgtaattgttctgcttgccgcattaaccgcaatgcttttcgataaccgctaggcgtcgcacagccaaaatgccgagcttgattctcggccaaattttgacccttctgaataccaataatggtgacgggccgttgagcaattgttgctaagccggcgattacagctggatcatccgcccgttgacgatcaccatgacaatcaaaaaaatcctctgtcaagccatcaatcaacgtttgaatgctaatcttactagcatcccgggctgcttgaacttgttcgtaggccgttactttagacatcctgatgacctccctgagtgattgttaataatcgttgtagtgttttccgtaaggctggtcggggcacaatttgatctaaccatccattggccaataaggtttccgcccgttggaaatccgcaggtggtgtctgttgaatggtttgttcaatgactcgccgacccgcgaatccaatgagcgctcgtggctcgctcaacataatgtcaccctgcatcgcaaaactagccgtgacaccaccagtggttggatcagttaaaattgtaatatacaatagtccagcttttcggtgatttgcaaccgccgtggacaccttagccatttgcatcaatgcacgagcgccttcttgcatacgcgccccgccagaagcagtaaccatcacaacgggaagtttttgggtcgtacaagtttcaaataatcgcgtaattttctcaccggttgccgcccccaaactccccatcataaatttagtttccatgacacctaacccaaattgataagtcgctaacgtcccaataccagtcaatacgctctcattcaagtgtgaggctgctttggcacgctgcaacttttttaaatatgcagggtcatcaaaactgacgggcgcacttaggtccgcatcccgctcttcaaaactcgccgtcaattgttgaacacgttgccaagcaggcaagcgaaacccataatcacaatggggacataccttgaattcaccgagatcttgggtataacaatcttcatgacaaactggacagcgcgtcaataacgcgtctggaatattatcccgtcgaacagctaactgccgttcagtgggtgcttgaaacttgcgcttgggcatcacttaaccatcctttcaaaaagtcttgttcgatataagctgtggtataggtaccacggccaacagtcgaatctgcaactaatcctgctaagaagatccggttcgtttgaaccccatcgatggtcaattccaataaacaacgatgcatcttgcgactgaccatcttccgattaataccgtgaacaatgattttggcaatcatcgagtcgtaaaacggtgcaatcatgctaccagtcaccacaccagcatcaatccggactcccagtgtccccattgggtagatcaaccgggtgatttttccaggttgcggtcgaaaatcgtggtatggatcctccgcattcaagcgacactccatggcaacaccatgaattttcacatccgcttgtttaatttttaaaggcataccagctgcaatttgtacttgcgctttaatcaattcaatacccgttaccatttcagtaaccgtatgttcaacttgcaaccgcgtattcatttccaaaaaataaaaatgatgctgctgatccattaaaaactcataggtacccgtatttgtataacccaactttttggttgcgtcagccactaattgtccaaattcggtccgttcagcagtcgtgatgaccgcacatggactttcctctaacactttttgatgattccgttgtagcgaacaatcgcgctctggtagataaataacatgcccctgttgatcggctaagacctgcacttcgatatgcttcgccggggcaatgattttttctaagtacaaccgatgatcatcgtatgaagcttgagcttcctgctgagcggttcgaaaagccttcgctaaatcttgatcattactaaccgcgcgaatccccttaccgccacccccagcagcggctttgatcataactgggtaacctaaggtatgggcagcttgcatagccgcctcaacatccttaagcaccgatggactgccgggaatcacgggtacgcctaatcgttgcatggtctgccgggcattttctttgtcacccatctggtcaatcacctcgggacgcggtccaataaacgttaactgacaatccgcacacattttggcaaattccgcattctcagataaaaagccgtagcctggatgaatcgcctgacacccggtcaaattagcagcgctaataattgcttgcatattcaaatatgactggttgacgggactcgccccaatacagaccgcctcatcagccagatgtacaaataagctctcctgatcagccactgaatagacagcgaccgctttaatccccatctcatgaagcgcgcgaataacttggaccgcaatttcaccacggttcgcgactaagacttttttaaacaatcgccatacctccttcaggcttgcattacaaaggttaaatcagcactaacaacctcacgaccagcacaggtaatcacgccatggcctgttccgatttgacgacgcaacttagttaacgttaccatcgcttctaaccggtcacctgggcgcacatccgtcttaaaatcagcctgccgaattccgccaaaaaagacgttattaccatgatgttctggcatcgatagtaaagccacaactcccgtttgagccaaaatttctaataatactggccgaatcatcgttcttccggtcagtgtctgactctgaaaaaaccattcattaatcgtgactaatttttccgctgttgcgctgacacctggttggaccgctacgatacggtctaataattgcagcggaaaccgttggggaattaaatccgtaacttccattaaacggtcgtctcctcaattgcaaacaatggttcatcaaattcaaccatagttgcattcttaattaaaacttctttaacgatcccactaactgggctagggacttcgttgatcattttcatcgcttcgattacacacaaggtttcccctgacttgacacgatcacccacctgaacaaacggcgcctgtttcgggtcggcagctaagtaagccaccccaactaggggcgccgtgaccatcgttgttcccgattgagtcgccacttcagtcgtcggtttgaccactggtaccgcggagtcggtcactgccggctgtgaacgcgctgaatttgtctcagcagtttcagcttgtttattcaaatgcagttcaaaggttgtcgtcttgacgtccatgacttgagcgctggattgattaaactgattgatcagggcggtcatcgcttccgtatccgtcatactcatacattcacccacttcttaaaggcaaccacggcattatggcccccaaaaccaaatgaattactcaaagcataggttgcggcttgatgttgagttgctggcgttactaaattgactggacactcaggatcttggtccgtacaaccaatattcgcaggtaactgacccgcttgcagagcaccaatcgttgcaacagcttcaattgcacccgcagcgcctaataagtgccccgtcattcctttagtactgctgacttgtacatcttgaccaaacaacgcgctaattgcttgagcttcggcactatcattcgcatgtgtggctgttccatgagcattgatgtaatccacatcacgcggttgaatgccggcttccgcaacggcttgttgcattgcacgtttggcaccagcaccatccggtcggggggctgtcatatgataagcatcgctagtcgttccgtaacccacgacttcaccaagaatctgggcgcctcgggcttgggcatgggccaacgtttctaagactaacgtcgcacccccttcacccatcacaaacccattgcgttgacgatcaaacggtaacgaagccaacgttgggtcagtggctttcgacaacgcagtcagggacgcaaaccctgcaataccgatttcgttgacggaagcttctgaaccacccgtgatgatcacatctgcctttccttgacgcaaatattcaaacgcatcgccgatggcattcgtcgccgacgcacacgcggtcacaatcgcttgactggtattctgtgcgttaaattgcatcgcgatattaccaacaaccatgttaatgattgaattagggacgaataacggtgaaactcgtttgggactcttgtcgtgcatcttgatcacttgcgcttcaatcgtcgttaaaccaccgatacccgaaccataaataacgcctaatcgttctgggtcaatatttttttcatttagtccggcttgcgccatcgcttcacttgcactgtatagaccataaacggaaaataaatccaatcttttcgctaatttcttttcaattcgttcttctggctgaaaatccttaacctcaccggcaactgtaatcccagtgggcgtcgcgtcaaacttcgtgatgggcttaatcccaacttgtcccgcgaataaccccgttaaaaattcatcaacactattaccgaggggcgtcaccgcacccattccagtcacaactactcgttctgtcattggataacctcccatatcttatatcgtcatgccaccgtcaactgttagcacttgtcccgttaagtacggttggtgcaataaaaagtcaattgcttgggcaatttcgtcgggcgtcccaaagcgtttgagtggaatatcacttaaggcagccgccgttacacggtcattcaattgtgccgtcatggccgtcgtaatcattcctggggccaccgcattacaccgcacttggcgccgagccgcttcctttgccgtcgttttagttaaaccaataattccagccttactagccgcatagttcgcctggccgatattgccatgtaacccgaccacactagcaacattaacgatggcgccttgtcgctgtcgctgcatgacttttaaagcgtatttggtcatattaaatgtgcccaataaatttgtttgaatcacactcatgaaatcttccgcgtgtagccgcgttaataactgatcatgggtcacaccagcgttattcacgagtccatctaagcgaccaaaatttgtcatcacggtctcaattaaatcagccgccgtttgatcatcgctcacatcaccaactaattgcgtcaaccgtggatattcagccgttaatgcttgccaatcggccgcttcaatttcatgatgaacgtttaaaataacgctggccccctgagctgccagccgtttgactgttgccaaaccaatacccttagcagctccagtgactaaaatcacttcatccacgctcacgtacctcctcagtatcctgacaataattctgccaatctgtcacatcttcaattgaccaaacccttacccccggcaatgtttgtttggcaaaagttgctaaactatgccccggtccaacttgaataatctcatcgacctcatatgtcgcaattcgttgtaagcaggccgcaaagtgcgttggcgatactaactgttttaccaacgtttccttgacagttgcctggctaaagggggtcacggtcgtattactgatgaccggaatttggggtgctgcaatattaacaaatcgtaatcgttgcgccaacgcctcactcgctgctgccattaacggcgtgtgtgaagccaccgcaacgtctaatgggaccacccgtttaacgccgtgtgtttttaaataggttcgcgcagcttgaataccagctgcatcgccaccaataacaatttgatcagctagattgtaattagcgggatacgcaacccccactgcttgggcactttgacaagcggctgcaaccagtgccggcgttaccttcaacgccgcgaccatctccccgggatgctgtaatcccgctcgttgcatatatctagcccgatcggcaactaacttcaagccatcagcaaatggcaggacgccagctgcaatcaatgcggcatactcgccaaggctcaatcctgctaacacggtcggacactcattaagcaacgctgttaaagcacgatataaccccatattcatcgctgtaattgcaaccggcatccgttgagcatcatcgatccaatcagcagttacccgcagatcccagtccaacacttgattagcttcgtcaatcgtggcttggtacgctggtaacgtttgataaagatcggcccccatatcggcaaactgttgtccttgaccactgaataagattgccgttttcataacttagtcctcgctattttcctgatgagtcgccacataatcaactaaatcaccaaccgtggctaaagcgtcatccgtttcgatttcgatatcatattcgtcttcgatcttatcgatcacttcaaaaacgtccagactatcaagtgctaagtcttcggtaaagttcgttgtcatcgtaatcttgtcagcatccacgtctaattgttccacgatcatctttttaatttggtcaaaaatttcagttttagtcattgttgattcctccagaatttttaaattaattttaaatgcttgatttcagttatcaattaatactcaattacgacactaccgacggataacccgccgccaaaaccggtaaacaccagcttgtcaccacgttgaacttgcttttgggcaaccatttcggcaaatagaatcggttcactggctgccgcagtattgccatactgtgcaatgttcatcggtaattgttccgtagctaagtttaatttttgaccaacgctcttaacaatacgtgcgttggcctgatgaagcacaaatgctttaatatcactcgactcgagccgtgcctgcatcaacgcctgctcaattgagtgcggcacttgcttagtggcaaagtcataaacccgccgaccattcatctgaaaggcccagcggttagaatctgcaccatcagtccgtgtcgaccacggattcacctgaggttgctgtcccgccgttaaataatgcccgtcagcgccaaacgtcgcgtaatgaccgcccagccagtgcccagtggtcgtattaggcttagcagtaatcaatagaccacccgcaccatcaccaaataaaacggcagtgctacgatcatgccagtctactaaccgactcaaggtctcgctaccgattaacaaagcggtctggcccggttgtaagtattggtgaaccaactgcatcccataaacaaagcccgcacaggcaacattgatgtcaaaggcaattgctttttcagccccaattgctgcctgtacttgaggagccgtcgccggtgtcaaataatccggtgacatggttgccacgatgatcaaatcaatcgccgtcgccgctagccgactttgctgcaacaactgctgggcaactgaaacagctaaactcgtcgttgtctcatcggtcgcgacgtggcgagaacgaattcccgttcgctgcttgatccaatcatcagaagtcgccatcagttgcgttagttcttgattcgtgactttggtcgtcggcagtgccttagcactcgctaaaatcgaaaaattagttgtcatggttggttacaattcggcaatgcttttaaaaaaatttcccaaacgacaatcgccgaattgccattaccacctttctattttgaatcagttgcaccaacgataaaggttaaatcagttgtgcaggctgccttgtcaccgaccatcgcctgacaactcaccgttcccatgttggaccgttgcttgaccatttggacatgcaacttcaagacatcaccgggacggacaattttgcggaacttggcatccttaatggcgccaagataagccgtcttaccagcaaacttttcagatttcaaaatcagaatcgacgcggcttgcgccaaagcttcaataatcaacacgcccggcatgaccgggttaccgggaaagtgcccttggaaaaatgactcattaatcgtgacatttttcgtcaccacgatcgattcacccggatttaattcatccacccggtccatgaataaaattgggtaccggttggggattaattgcataatttcacttgcttctaacacactcatagttagtcgctcctttcacggcgtttgggaatggcattaagttaatcgtccggccaaatcttgtcaattgatttcagcagattaatttacagtatgttacattttttagtagccaaatcccggtaagctgggctctaatcgagctttatttttttgcgaaaatttcttgacgagccattttttgcggtcataatccgtcaacgaactggcacagtttagcaatttgactataaagtttataatcaaattgctaacaagttttgacttcagcaagcaatgatacaatctgttcaactgtcactagcttagatgcacgcaaaaaaaattgcatctaagaactagcattcttaaacacaattgttgtgacgatctattaatttaaaggattactcatcagtctaaagccatcacatccataagattttaacgcccataacttttaacctaaacggcaacgcttgttaatttttgaacatccccagagattgttggcggtaaacggatggactctgatgaaaccattttttaaaagctctcgaaaaagactctgggtctgaataccctaacaaatagctgatttcaatcaagtttagcgattgatctttcatcaagggtaccactagggttcgacgcgcaatttggacttcatcattaaatgtggtgcttaaagtactaagatgacgctgcaaggttcgtttactgagattcaaacttgttgcaatctcgtcaattgagaaggaaccactaggaattttcttcaacaatagtgcttgaacagtcgcgagcaatgattggttgtgttcaatagccagtttttgttggtctaaccctggttgcaaaaatgcccacattgaattattggccgaaataaacgcccgctgtaagtccgtgacttgaaactgaatgcaattatcagccaattgttgaggtcgaatgcccatcacggcatcaatctgatcaccatacggatacttactaccaactgaaattggcttgatgagttttcccgtacctactcgtaacaagctgattaacaacaattgttccgtcataatcgtgaaacgcggcaactcgacgccaagactatttcccaaaatatgaatattgacaatatctggcttggtcactatctctaaatgaaccggacctgccaatgatttataggttgccatgcgtgcaatcgcttgttcaccatttttagcagctaatgctgcaaaaaaggacggcataaacgtattaatgttagtaatattccctaaactaagaatcatttcatccgtcaattggttgtcgaattcgttcattaactgccaatactccacatcagaaagcattaattgttcttgccaaaccactttattaataccggcagcttcaagcaggctatttaaatcaacgccaaggcttgccataaaacactgaaactgttcagaaaccataatcttcacactaatcactcctactaactggcatgcatcatgataaaatcaaaaacacgagtcggtaaaatcgccttagcaagtaccagcggtttagccccaaatccaattaaataacgcacccgtggtcgtttctgattgaccgccttcgaaatagctttagaaataatttttggatcagacatcattcgcgacgagtattgtcggcgcatacccgcggcagccttggtcgcttgtgtttgatatgcactgtgacgtgctgaggcttctaaatgatccgcagcaatgaatccccagttggttttaatcccaccaggttcaataattgcaactttaatgccaaagtctttagtctccattcgtaatgcgtcactaaacgcttcgacagcgtacttggttgcgtgataccatgcgcccatataactcaccaaccgtccacccatggaagaggtattgataatgcgtccttcacgttgcgcgcgcatatacggtaaaactaattgtgtcagccgagccatcccaaataaattaacctcgaactgttgcctggcttcatcaatggaaacatcctccacagcgccatatgagccataccccgcattgttgatcaaaacatcaatgcgtccttcactggcaattaaagttgctacggcctgactaagcgactgctcattggttatatctagtgacaagggcttaacgccgtatggggctagtgcttcaagtttattcaaccgccgcgccgcaccgtaaacaacgtgaccttgctgtgctaagtctttcgctgtctgaaacccaataccgctgcttgcacccgtaattaaaataactgccatctcaatgacctcctatgtttttcaataacaatagtttacatagaaaatcgcaacggcttaatgatttatcacgtcatcatcataacataatatgccattttttggcgcaggccattaacagctgatattaatcaactcaaacaactgcaaaatcacactcattacgcctggcgctgttgattaagccatgatggtctaagtatttaaaatagctacaccacccaaaattcgcttgaaattaatttcaggcgaattcataaacatcctgctgccaatttctcatcctaatcaccatccgccaatgcccccgctaactagccggccctgcacttccgattgcaatataacccacaacaggacgctgaaacccaccatgacacctaaacactgcccttcaaagcctgttagcgtcggcagttgcaagagtccgagcttgcgccgtttttgacgggctaacttaatcatgacttcactcgtgaccacaactaatagtggtaacatcactagccagcaacggctgccgaatgaatcagccaagccggcactattaaaatgtgtaacaactgtttgcggtgccaaaccaatcataatgacacacatcaaaacggcaccagccacaattgttcgcacgatccaagtaaagactcgcattacgctcacctcatttttgacccagtatagcaagcgggcgacagcacggacagcaaaatgcgttcttttaaacggttaattatcgaagccaactacaatcgtgcgaccagctagctttaatgacacggttcaactggttgcatgtcttttttctaataccaacgcaaagactagtctaaatcaactaagcttgattgatttttaccattaaattatcgccatcgaaaaagtcgtttcagcacgatgaatcagtactgaaacgacttttaatcgattgcttttaagcgactagttacctagtcgagattaatcaatggtaatcatagccttaattgtctttcgattttgcatgtcttgataagcctgattaatgtcggctaatggatacgtttgcgtaaatacccggcccggattaatattaccgtccaaaactgctttgagtaagaactgtttgtcataagtcgtaacggaggcggaaccaccagcaaccacaatattttgagcaaaggttgacccaagtggccggttattataatgtggtacacccacatagcctacgcgacccccattatgcaaaacacctaaagcttggtcaatggccgcttcgatgccgacacattccaacgccgcatccgcgccgccaccaaggatttcacgtaccttcgcaatgccttcgtcaccacgttcagcgacaaccgcggtcgcgccagatgccagtgccatttgctgccgatcttcgtggcgactcatcaagacgatttgcgcggcaccccgcaacttagctgcaatcacagcacattgcccaacggcaccgtcaccaataaccacgactttatcgcccttttgaacgtttgcacaccgtgccgcatgataaccagtcggcatcacgtctgccagcgtcaacaatgacttgagcatcccttccgtatagtcactaggttgaccaggaatcttaactaacgcccaattaccataagtgaagcgaatgtattctgcttgaaagccattagaccaatttgtgtggcccagatgccgatcacaagtaccatcgaaaccagccaaacaagccgcgcactcaccacagccatgggtaaatgaagtgatgacaaagtcgcctggcttgaccgtcgtaatggccgagccaattgcctcaacgattccgatagcttcatgtccttcgttgatcgaatgggcagccttgtcatcaccatgcgcatatgaccacaaatcggaaccacaaacacaagtccgcacgatacgcacaatgacatcatcatcagattgtaatgttggtttgtcaacttcctgaacagatactagtccagctttttcgaaaattgttgatttcatcctaatcacctttggccgcctcaaccaaaattcaatcagcggtcgttcccttcatcattaaaataataatattaaaactaatacacatatattataacaataatctgcacgcaccagttactgattgcaccaagtcgggtatcaacaaatactttagttactcagataattgtgaccaaactcgcttgttacttatcattcagaagctttccataaaaaatgcgcccgaccatgttagtttcctagcaaggtcgggcgtcttccctttgtcgattgaccactttcaattcaagctcgaacccactttaatagtgccgtagctgccaattcatggaagcgagcgccataggttaggcctgcgtcatcacagcggtaatttgattgatgtaaggtcccattaccgcctgaacctaagaatccatagaatcctggaatacattcttgatataacgcaaaatcatcgtcggcattgcatagctgggcaggcacaatatcaaaatcatctttcagaacacgtgatagtacagcggtaagtgccgcgttattgttgacacagcttggtcctcggtcccaatcaattgtagcggtttgctgattcatcttggcagttgcacgcacaatatcgtaaaaacgtactttagctagatcccggttagccgtgttgaaggtccgaatcgtgcctcgtaaattcgccgtatttggaatcacgttaaaagtcgttcccgcttggacggcagcaatcgttagcaccagtgctgcgtctggcgcaatatttcggctacgaatggtctgtaaattactgatcaattcaccaagcgtcacgatgggatcatgacttgcttcgggcatcgctgcatgggcgccctggcccaaaattgtgacgtcaaaattatcattactagccatgagtggtccagacttcatcgctaaagtgccgactggtaaattcggcatattatggaatcccgcaatcgcacgaacacctgctagaacaccattatcaatcatcattttggcaccgcggtgtccttcctccgcaggctgaaagatcagtcgcaccgtaccattgagatctacctcatgcactttcaataatcgcgctccccctaataaggcggccgtgtgaaaatcatgcccacaagcatgcatccgaccaggaatcgttgatctaaaggataactcattgtcttcttggattgggagtgcatcaatatccgcgcgcaacgcgatgattggcgcaccatgcccaatctcggccaccaccccagtttctcccggatagtctaccaaccgaatgttcaactcagtcaatgtttgcttaattaaagcggtcgtcgcgacttcctgcagtgctaactctgggtgtgcgtgtaattgatggcgcaaggttgtcatccaagctgctaaagttgttgtcatcatctgaaaagccccctataaaattttcaagaagatcgacgcaataatcactgacgccactgagacggttgcaaaaccgcccactaacattttaggtaacatctggtctagtaaatattgcttttcctccgcagtcgatcccataatttcggtcacttcatgggtgacgatatagtccgcggggaaaccaaataaggcagtcaatgcacttgcaaaagccatttcgcggctaaatcccaacggtcgcgccaataagctagatgcaatccacatccctaaaacaccaagaacgatcaacgttacaatcgggatcaaaataccacttaacatgctgattttaacaatgtttagattggcaaaaatataagctagcagaccatacatcagccagtgaaagacgcccgctttctccaacaccgcatcttctaaaaagcccaactgatgcgcgataacaccaaacactaaacaaatgatgtactgattaaccgtgccatgggctaactgggcagtccattcagccaacccagtcacagcagcgactttaaataacataaaagctgaagtatcataagcggccggtagttgccaatgccgtaattgaggttgaactgatttcaccttcgctggtacggttggtagcgggcacactggtaattgcgccgttgtttgaactgtcgcactggtggcagaatcagcggtcgcgaccgtgacgtctacatgtcggacttgcaatagtcggcgactctcccgttttagcatccacgcggttagcggataaccgagcatgctgtgcatgacaaacattgccaccggaaacgccacaagtgcggtaatatgttgggccttgagtccagctgtcatcagaaaggcagccactaacccacccgtcaacgggggcacactggcaacgatcgtgtgccaatcaaataaaagacggccaattcccatcgtgagcaccactgtcccaaccacgccactcagggcaatcacaactgcgcgccactgttttaacaacaatttcagatccatcaacgtccccatatgaaccaataaaacggcttgggtaatttgaataaaggcagtgccaaatgaagcagcagggacaatgtttttgggaacaattgtccaaaaacccactagaaataagagtgccgtaataaatacggatggaacataggcccgactgcgcgtggaaacccactcgccaagcatcataaaacccatgacaaccattagagaaagaattgctaccattaccatcacttccattagcttaatttacgatcggctttttctaatcgtattatcataatctaacagaaagccaatcgtaaaacgagccgttcaatcagatttcgtttaaatctaatctcattcgcaacgacacaaacgattctaaagtatcgcacctagttccgataagattccaaatactagattgactgaactaactaagcaaatttcaatcaaaatttaaatccatgggacaatggactgggcgttcataaataaattgacgccccaatcgaccatctatgcggcgatgcgtatcagtgaaaccatgggtcaggtataaatgttgcgccacatgattggcatgattgaccgctaataatattgtttgaatcatcggataatgactggcaagataacgtggtaattcggcaagcgcgtcagacgcaacccgctgatgcttaaagcgatcatcaacagataaagctcgcaacaaaatcgtattcacttccgtttcaccgtaactgagcggtccttgaccaacatgcaaacagaaaaagcccactaattggttgccattcataatcataacggccgttcgttctaaatcagatttgcaagcacgaataacttgttgtggcgtcgccgtgtacatcacattaaccagttgatactgttgtatttgcttcagtgctccccgtgtcgtcgaataacgtactaattgaatcatgaccatcacacttccatttgaccgatttagcacttagtgtaacagtccgtggtcatgactgggaattttaataattcaattgttgaattgactaactggcgctcgattcagcctgcactactaatccaccacaaaaacggcatcggaaaaactgcccgatgccgtttggtgatattcgattaaaccagttaatttcaaatacgattcaagtacttcatgggcgcaataaaatcttgccagcaacttgcccggtctcaagggcccggtgcgcagcggctccttctgctaatgaatagactgtcgctggtcgtatcgtcacgcgatgcgtgagcacatcatcaaacaattgattggcacggcactgacgagcagccgcgctgtccaaataatcccataaatcaccagtcatcaaactcttggattcggacattagcttgactggatcaattactggtggattgccagctgccatgccataaaaaatgacccgcccacggtgcttggtagtcgccagactaactggtagtgtcttaccgaccccatcaaataccgtatcaaaaaaattatgatgggtcgtgtcccaaggatcatggcgcataaaaacggtggttgcgccagcttgataggccaattcagctttcgccggtgttgacgccacaccataaacagccacctcattggccacgagcagttgcgttaatagctgcccaacaccaccgctgatgccatgaatcaagactcgatcgtgcggttggttttgtgccaagtcatggactaagaactccgcagtcatgccctgcaatccaatgctagcgacctgctgatcattgattgcccgtggtactttaatcgcctgatcagctggaaccgcgacaaggctagcgttggcaaacggcacgtcaacgaataacacccgatcaccgcgtttaaaattcgccacttgcttaccaactgccacaaccgttcccacgccttcataaccatcaatgtacggttgatgcttttccaaatgataggtaccacgacgacgataaatgtcggcaaagttgagcccgatatacgttgttttaaccaatacagtatttgcagtaacgattgggtccgccacctcaccgtactgtaggaccgacgcatcgccaaaatcattaaaaaataatgctttcaactaatcacccgtcttttctaacaaatcgtcaatacggcccgatgctgttaccaacgtcaagaaacggtggttccaaatccgatcttgataaaaatcaatcgtttgttgcgcactcatcatggaattggccgtcgttgtcgtcagcccccgaaccatttcgaggtggtagcctaacccatgagccattttaaccgtcgtatccacacaaaactcgacttgcgcaccacagatttcaagtgtttgacatccaatcaccgtcaattgggcttgtaaatccgtgtgataaaaagcgttggcgtgcgttttctggaccacaatatcggttgcttcaattggcaactctggtatcatctgccaatcggcagaaccagtgactaagtcagcatcgtgatgttgcacaaacacgattggcttattttgagcccgataactcgtaatgcgttgttgaatacccgcaatcacggttgccaaattggtaaccggttgggacccgcgacagacaccaacttgcatatcaataataatcagtacatccgccatgttgacccctccgtaaattaatttaactggcttggttagcgtcaactattattaacgacgcccacaaagcagtaagctgtttttagactagcacattatccgagcgtttcccagcatttaatcgaagtagcccggcacaacaacatcgtaacaaataagatcagtcaactgtatcagccgtgcgaccatccaatgcgcgccgcatccgtcgcgtatagtcccttaagactgctgtcgctggttggtgcgtcgcaatcaaatgcacgactgcactaccaacgatgaccccgtccgcaatttgtgccatggcctgggcctgagctggctcatggataccaaaaccaattgcgacaggtaacgtagtcgcatggcgaatcttcgccaccagtgttgctaaatcagtcgtgatgtgtcgccgggtccccgtgacacctagtgatgatacgacataaatgaagccccgcgcctgctgggcaatcgctgcgatgcgtgcatcatcactcgttggcgcaatcaatggaatcaaagcaataccatagtggtctaaggttggtcgaagttcaccagaggcttctagtggcatgtcgggaataatcaagcctgcgacattcaaactttgacactgctgggcaaaggcagcataaccaaactgataaacaatgttcgcataggttaaaaacacgagtggaatagttgtcttctctcgaattgccaccaccaattcaaaaacgcgttggggtgtgatgtgttggtcaaacgcacggagatcagcggcctgaatttcgggaccatcagccacagggtctgagaacggaatgccaatctcaacgagatcacaacccgcttctgctaacgcaacaacttggtcaactgtcgcttcaaaattaggatcaccggccactacaaaagcaataaacgccttatgatttttaaaaattgttgttaaatcagtcatcaattgtcacccctcgatactttgcaattgccgccacatctttatctccacgaccggataacgtacaaataatagtttggtcacgtcgcatcgttggtgctaattgttgtacgtaggcgactgcatgggcactctcaatcgcacagatcaccccttcgaccttagcaatcagttcaaatgcttgtactgcttggtcatcggtgatccccacatattgcgcccggccactcgcagccaggtaggcatgttccggtccgacgcccgggtaatccagcccagccgagattgaatagaccggggcaatttgtccggctttatcttgtaaaaagagtgacttcatgccatggaagataccagtccgaccacgttcaatcgtcgcagccgtcaacggcgtttgaacacccttacccgctgcctcacagccaatcagctcaactgacgtatcatcaagaaaagccgcaaaacttccaatggcgttactgccgcccccaacacaagccacgacggcatccggcaaatgacctgtttggtccaggatctgctgtcgggcttctacactgatgacactttgaaattcatgtaccatcattggaaatgggtgtggtcccgttgcagagcccatgatataagctgtatcatcacagcgccgcgtccactcttgtaaggccgcattgatcgcatcctttagcaccattgaaccagtcgtgaccgggtggaccttggcccctaatagttgcatccggtaaacattcaatgcttgacgatccgtgtctttcttacccataaagacgtcgcattccatcccgaacaaagcagcaatagttgcagttgcgaccccgtgctgtccagccccagtttcagcaatcaatcgctttttgcccatcttctttgccaacagtgcctgccccaagacattgttaatcttgtgcgcacccgtatggttcaagtcctcacgtttaaaataaatctgagcaccacctaattgatctgataatcgttgtgcatggtacaacaacgatggccggttcgcatagttattcaacaagtcagtcaactcttcttgaaactgcgcgtcctgtcggtaatgttgaaaggcgcgatccaaccgctgtagctcggtcattaatgtttctggaacgtactgaccaccaaagtcgccgtaacgccccgcctgtgattgatttttaatcatactaattcctcctaatttctgttaataatggtgttgacacgcccgtttggtgcgcccgttggaccatcagattgattttttcacggtctttattgcccgccgtctcgacgccactagccacatcgaccattgccgggcacaccttgttgattgccgttacgatattcgtcggtgttaaaccaccagccaagataaacggccggacgggacgctgtgattgtaattgattccaatccaacacctgtccactacctggacgggcattatccaataataagtaatccgcttgacattgcgtagcattcgctggcgtcatcgcttgaatcaccggcacatgggcggccattaaggacgcaatccgaggatcatcgacggtagcgtgtagctggaccacctgaataatgtgctgttgcacgagagctaaaatttccgataattgattagttgtaaacacgccaacacgccggatacgcggatctaattgctgtgacagttggcgcgcggtcgccatcgtaatccgtcgtcgtcgaccgggggcaaataccatcccaattgcgtctgggagcgcttgattaaccatcacgacatccgctggttgcatcaaaccgcaaattttaatttgtgtcatccacgcacccccgcccgcagttgtctgacagcttgctgcttatctggcgcacgcatcaacgtttcgccgactaaaatagcgtcaaagtcggcggccgccaacgtttgtacttgcgtcgacgtttgaatgccagactcggcaatcacataacactcagccggaaccgcttgccgcaactggcgactcgttgcaaaattgacactgaaatctttcaaattccgattattaatgccaataatccgggccccagccgccaccgcttgcttaatctcagccgttgtatggacttcaactagcgcacttaaattcagctcatgagccaacgtaatgaaagcctgcagttgaaccggtgttaaaatagcaacaatcaataaaaccgcactagcaccagcaatacgagcactcgcaatctgactagcagctacaataaaatctttacgtaatgtgggtaccgagaccgtttgcgcaatggcttgtaagtaagacaactgtcctttaaaataccggggttcggtcaacactgagatggcatcgatcccagcagcaacatagtcttgcgcaatctgtaaatagtcaaactcagccgcaatcagccccttagaaggtgacgcccgcttaacttcaccaataagctgtaagcccggctgggccagcattgcttcaaatgataaaacgggggtggtcatttttcgagcttgttgaatgcgcttcacacgctccctaactggtaccttctgaacccgttgctgactcgcctggacgagttgatctaaaatcatgaggccatcaccgcctgactactctgaattaattgggccaacttagccgcggccgctccttgatcgattgtttgctgggccaactcaaaagcggccgctagatccaactgtggcttggcaatatgcaacgccgcggcggcattcatcaacaccacgtcacgaggggcccccggttctccagcgagtactgctcgcgtgatggcggcattaacttgggcactaccaccaataagagccgcatggtcacaacgcgtcagtccaaactgttcaggcgtcagggttcgcgttacttgctgcccatgattaattacgatcacatccgtaggggctgccgctgaaatttcatctaagccgtcccggctatgcacgaccatggcatgtttaacacctaaacgcgtcaacacttcggctaatggggccatcaaagcttgccgatatacccctagtagttgcatctcagcatgagctggattggctaagggacccagtatattaaaaatggttggaatcttgatttgttgccgggccggggcgacgaatcgcatcgcctgatgatattcgcgcgcatacataaaggcaaaattggtccgctctagcaatgctagactctgagcaggtgttagatcgattttgataccgagtgcttctaaaacatccgccgcaccactcttggacgacgccgcacgattgccgtgcttggtcactggtacacccgcagcggcgaccactagcgcagtggtcgtcgaaatattaaacgaattcgaccggtcaccgcccgtcccaacgatttctagcgtgggccgtttaactttaaaaggtaacgcctgggaacgcatcgcagttgctgcaccagcaatttcatcgatagttgcctttttgatggctaaggcggtcaaaaagctcccaatctgtgcgtcggtggcctgacctttcataatttccgtaatgacttgttggctcattgtaaagtctagattttcttggttagtgagttgtgcaatcgctgtttcaatcataagtattcctccactctcgtctgcttaatgtttaagtgctaaaaaattacggatcagttgctcaccaacggcggctggcgtcatgattgattctggatgaaattgaacgccgtacagctgacggcccacatcttccactgccatgatttcctgatcatcgcttgtcccaatgattcgaaagttaacgggcaaacggcccgcatcagctaccaacgagtggtagcgcgctgccatgaactgcatcggacaatctttaaatagtgatgacggctgcacgtgcattaacgtggcttgcccgtgaactaaatgctgggcgccttgcagcgaaccgccaaaagcggtgaccatcacttctaatcccatacaaatccccaatatggggacctgaccagctaattgttgcacgacttgtggactaactcccgtgtgggctggcgtccccggccctggtgataaaatgatatggtcaggttgtaatgccttgattgcagcaaccgtcaaatcgtcatttttaatgacccggacatcgggcgtcagacgaccaattagttgatacaagttataagtaaaactgtcatagttatcaattaataattccatctttaactcgtcctttcgcgtcttgtactgcattaacgatcactcgttgtttattctggcactccttaaattcttgagcgccgatactgtcagcaacaatgcccgcacccgctggaatcactaaccgttcattcatccggtaggccagccggatgccaatcgccatgtccaaattaccgttacaatccaagtaaccaaaacaaccaccataaacaccccgcggcacctgctcataatgattaatcagggtcattgcttcaatcttaggcgcgccagctaacgtcccagctggaaaagtagcggcaagcacttggagtgctgtagtagtcggcgccacttctgcggccacccgagaccctaagtgcatgacttgcgaataacgaattaatcgccgtaaattagtcacccggacacttttaaactttgcaacttgtcctaaatcgttacgtcccaaatcaactaacatattgtgctcggcaatctctttagggctggtttgtaattcatgagccaactgctgatcctcggcaggtgttcgaccacggcgtctcgtcccggccaatggatacgtcgcgatttgttccccatccttcgtcactaacgtttctggtgaggccaccgtcatttcgaaattagcctgtttaaaataacaggtatacggggccgctgttttttgaagttgctgataaactgccagcaatgacccgctcatggtccccaaacatggattagcatatatcatttggaaaatatcaccagcgtagatgtgttggcgaattcggtcaacctgacgcgcataggtcgcttggtccagttgcatgtgtaatggttgctgcaagtcaaatggtggcaaagctattgattgctgcaattgttcaataatggcggctaactgttgcgttagagccgtttgagtcacggcgtaagttgccgctaaatccgcagttggaatcagctgtgtcaacccaagctcatgatgtcgatgatcatagacgagcacactcgtaactaagaataaacctaagtcatcgagatctgcggttgctggtgatttcaaatgcaacttgggtacaaattgttgaacatactcatagccgaagtaccctatcaagccccccgtaaatggtggtaatccttgaattcgtggtgttcgatattggtttagaatggcttggagtgtctcattagctggtcgtttgtgcttggctagttgccggcccgtgagacttcgctgtggtttaaaactaaaatagctatatcgttggtgccgatcaatcgtcagcgcgaaaccgttccccatctggtggacaattttagcaaccgcaatggggtcaaatgtggcgagtggtcgtttgaccatcactggtacgtagggataacgatcctgataaggaatcaaggttggtaatgttggattcatattgaaccactcctcattaataagatagttttacttgagttgtggttaattgccatcgttgctgcattgaactgccccctatcaaaaaaatccgtccatgactaatgacagtcaaggacggatttttccgcggtaccaccttggttggacaccaaattaccccattcaggttagacttgggtcccagcttagcgaaatgcaaacacattcccgggaattgacggctccctatcgtcgcgaggtagtagaacaaagctgttcgttagtcgcgccctcagtggtccatttaataatttgcgttcgatcgcactctcagcaacggcgactctctttacgggcatcattatcttgatctccacttcatcggtttcatggacgaatattaagttgtcattaacattaaaactcaatgagcaatttgtcaacacttttatcttaatttaatattatgtgactgtgaaattaacacttattagtcaagttgctgccaaaaagtcttgtagtaatgccagaccaaaccagcagaaatagttccgacgccaactaatacaatgatattaatcagcatagctgccgccgcgaacagctgaatcagcacactatagatcacaattgtcagcacacccacaatactgcaggccaacaagttaagcatcaaaccaagattaccgccgccccgattaaacaattgggtcacattagtccaattcgtcagccgtagctgataatcacgcttaaagtaatgttgggcagctaggtacgtcccccaagcagcgcccaatattagagccaaatctagggctaatggtgctcgcccagcgatacccaccactagaaccatcacgccattaatcatgatctggaaccaataacccaagtaaaacttttgtcgtaagtaacgggacattgggattggcagtgcacgcacaaagtcaaagttcattttatcaagtgaaatgagattaccgactaatgaggtttgattaacattgacgatcgcaccggccatcccactgacaaaccagacaccgagccagttcagcgatagccgactaaaattaggagcggtccccgaaaagaaaacggtcccgactaaaatcaatggcagcaggattgaatctgtgaataattgtaaggctaaactgggttctttcagtaactgaaactggtaggtacgcaaaattttattgcggttatgttgtcgtgaatgtcgacgcggtggtgttgccactaacactgaattgacttgcgtaagctgttccgctaagtgggtcaaaacaaaccgtcctgtcagtgcgaataaaatcagcgagatgacaattaaactcgcccaggttagcaaactcgtcattgtcaacggcgtcgtgaaaactttaaaaatcggtatcaataggggtaatgctgcgcggtcaacctgcgttccggtgtcagatgatgagccgcgattcatgaagtagagcccgactagcactaagacagcgttaaggcctaacatgacgttcatcaccattttttgatgggcgcgaaacacggttagcttggttaagccaaaaactattagggcgcacaagcatagtaacagactcagtattaggccatacatcaagacggccatcagcacgcctaacaccacaaagattcctgcccgtgttgcggtcatgataaaaattaagagtaacggaatggtaaagggtaccgtgttgaatatcacgaccaaaatcttactcataaaaatttcttgattgcggaaaggtaacggtaagtattcaacaagatcattgccggcaaaaaagacgttataaatacccgagatactctgtgaaattcccaataagataaataacgccacatagaacgtaaacatgcctggcaacttgctaaaatcaaaggccaacatcgtcaagccataaatgccaagaaacatcaaagcattcaagtaaaattgccgcattagcttcttactcaaggctggccccgaagcgccctttttacgtagccgatccgttagttgcggattcaacaacctgagattaacagccaacaaaacacgcaactgacttttatgcatcatgctcaccctccagcgcatcgacaaggtgatcatccgtcaaccgcccggccatttgtaaatatatcgcctcaagtgattgttgcggatgttgagctagtaattgttcaaccgaaccggtataaatcaattgcccctgcttcaaaattgctaatcggtcacataactgctgcgccgtatccagattgtgggtggaaaaaatgaccgtcttgcctttggcagcatgggccttcatcaaattttttaaatcaaaagcagcttgggggtctaacccttgcagcggctcgtctaaaatccaaatatctggatcgggaagcaacgccccaatcaaaatggctttttgccgcatcccgtgtgaataactagccatgggttcgtcaacgtgttcagtcatatcgaacagtgacaccagctgctgtcgccgttgctgaacggcttcctctgattgctggtaagcggcagctatcaagtcccaatattccatcgccgaaagttgaagaaaaatatcgggtgtgtccggtacgtaagagatcttttctttgacggcttgtcgttgctgttcaaggtctaagccatcgaccgtaaccgtgccactcgtcggtttaatgatactgactaagtttttgatcgtcgttgatttacccgccccattgtggcccagcaaaccgaagatttgtcctgatgcgatggttaaagtaagctgattcaatgctgtcttatccccataacgttttgttaattcgtgaatttcaatcatgtgattatccccctagtcatcagttacggtttattataccggaatcgtctgaaaattcgaaaccggagcggtacgttgctcattgattaacgcttctgtcgccaatgactagttccatcatgaaactaacgatttcaccgatccagaagcatcagttaacctcaacttctagggcaagtttcatcagactgttgattaaaaacatattgcaaccaagaaccgttaaatcacctgcccccaagatacttatgattctagttcgatcagggaccgtcttatttttaataattgtcatatacaagcaaatcatttaggaattttcatcgccataaatcaagcacaatttatccgctggcattcccatgttaggcctttttgttacttacaattctgaaagaactccactaagtccaattaagaagctggtaccgttgctgtaacgccaaaaagttcttctctgacaaggcatcaggccctctcaaggaagaactttaatttacactttgttatttaaataacggttttccatcgcctggcgggcaagaacagcgtcctcaaagtgctgaaacggtttgtgtaacaggtagcgccccttgtagaaaaatgtcgccacccatttctgagtattgctatcccagctgacaccgatgacaccactcttattacgcttagacataatctttgacggtaaatcagtgtgatgatcatgaattttcagattgcttaaccgccccatactggcagccgttttgggattacgtcgaattaactgcgaccgactttctcgtgtcaaacacccacagcttcttgctcgcccatgccgcaacgcgtacgaatcagctttggtctgattgccacagcgacactgacacaaccagagggcattgccatttttggcagttccacaacgtctaatgactgttaagcggccaaacttctgacccgtgatatcgattaaagtagtcatattaacgcctccatttaacggctaattatgacgtttcttcaaaattgcactcacaccaactagtaaggttgctgcagtcaaaccaagtagttccgccgcaacactagcttgccgatcatcattggtttgcggtaaagtcgcttgtttgtgggtggctgattgatgagccgcggttggcttaacggatttagtcgtcttcgccagtttaaccgtttttacattggctggtcgtgtctgagcaggctgttcaacagcctgtgcttgtttgagatccactgaccgcttgacgctagcttgtttagcagttgttgttgcgacggtctgagccttatccggcgtcttgaccgttgcgactttatctggcgtgtcagtcgtcttaattttatccgacttattaactgtcaccgtcttcactggtgtttttggtgtctcaccggttgaaagcctatcggtaacgtaacgaatcgtttgaacatcatccacgctagctggcgtaaccatgactgcctgagtacccgttaccaccgcatgatagcccggaatactgaacgccgcgacgcgctcaaaagtgtgatccgcctgattagtcgaccaattgctatacgttacgtccccggtgacctgatcaacccgtttagtacgagtgaatgtcatcgctctgaccgtatcatcgtgcaactgcgtgccagtcgtactctgataatgtacggtttgcgtgatcgtcttggtctcggttgtcgcagttgtcacatgtgcaagctgaaccagatagctgtgaacaacaccatcatcattgaaaatagctcctgaaactggatagctatcgcggacaagcacgtagccctgattactgtaatcagcaattgtgttagccgtgcggtaatcggatgatgtctgataatcgccagtcaaactgacggtcgcgagcgttttatccgtggtgacatcaacataggtgaccgtcgccttttctgcgttaagcgcatacgtcacaataatgttggtcggttgcgccgcactagttactgcatcgtttcccgtgacccgcgcccggtcagccgtatagccaataataacgggtgacgtcacggtggtataacgaccagtagctgaagtcccatccagccaatcagtataaactacggtaggctcaacttcatcaatcgtggcatcccgattaaacgtaatcagttgaacgctgtcagtgccagccgaagccccattttgataccgatacttaatcgtttgactgacttgtttcgtcagatcttgggcggtcgttcctactggatacttcggtccgtctggattgtctggatcaattggttggcccggcgtacccggattacctggtgtaaccgtgactaacttatgcttcagtgtcacggtataagttttagcaaaatcatcgacatcgaacagcatccccgatacgggataattatcacgtaccagttcataaccgtttttaacataacctgcaatggtttcagcggtccgataattggattgtgtccgatagtcaccagtcaaattggccgtagcgagcgttttacccgccgtgacatccacataagtgaccgttgctttttcaggtttggccgcataggtgacgaccacctgtgtgtctgaatctgtattagcaactgaatcacgaccagcaacctgtgttttatcagccgtatagccagtaatgacgggtgacatcacggtggtataacgaccgctagctgaagtgccattcaaccaatcagtataaactgcggtaggatcaacttcatcaatcgtggcatcccgattaaacgttattagttgaacgttatcagtgccagccgaagcgccattttgataccgatacttaatcgtttgactgacttgtttcgtcagatcttgagcggtcgttcctactggatatttcggtccgtctggattgtctggatcaattggttggcccggcgtacccggattctctggtgtaaccgtggctaacttatgcttcagtgtcacggtataagttttggcaaaattatcgacgtcgaacaccgcccctgaagtgggatagttatcacgtacgagttgatagccattcttgacatagctcgcaatcgtttcagccgtccggtaactggacgtagtctgatagtcaccagtcaagctttttatagcgagcgttttacccgtagtgacgtctacatacgtgaccgtggcgttctctggcttagcctgatacgtgaccacgatgttcgtgtcagcatccgcattgtgcacctcgtcattacccgcaatacgcgttgaatcagcaacatagcctttaatttccggtgaatcgactggcatgtaacgaccagtcgttgccgtaccagtcaaccaatcggtataagttagcttattgttaacctcatcgaccgtcacgctgcgcttgaaagtgattgtttgcgtattagcgtcggcagcagtacttttatcctgatactgatagtgaatggtttgatcaacttgcttaatcaagtcttgcacagccgtacccgctggatatgtgggtccgtttggattatcagggtcgatcggctcgcctggcgtacccgggttctctggggtgagcggcaggagtttatgttgcaatttgacagtataagcctgagtacttccgtctttatcaaacacagcaccggatgttggataatcatcactgaccagttcatagcccatattaaggtactgagcgattcgatctgctgtccgataattcgagacggtctgataatcaccagttatcggatctgtcgtcagcaccgctcccgttgtcatatcttcataggtcaccgtggctttttcaggattagcctgataataaacttatacatctggactgagatccgtcccactcaccgtatcacgacccgcaacactggttgggtcagccgtataaccagtaatcgaaggtgaatcaacagcctcaaaacgaccagtcatggtcccatcatcagtcaaccaatccgtgtagacgactgtgccattaacttcatccaccgtgacgttacgactaaaattaaccgcttgaacattgttcggtttagcagtgcgaccatccttgtataaatactgaatggtttgactgacttgctcagttaaatcctcaaagtcagtccccactggatatgtgggtccgtttggattatcggggtcgatcggctcgcctggcgtacccggattatctggcgtgcgtgttacaaatttatgaacaagtgtaacctggtacttttgaacactgccgtcttggtcatagactaccccggctgttggatagtcatcacggtacaattgatagcccgcattctcatatgcggcaatcgtatcagctgtccgatacgcatccgttgtcccgtacgctccttgtaagggttccgtcttaatgaccttgttatcagtttggtcaaaatacgtgaccgtcgcatactctttgttcacggtatacgtcacaggaatcgtcgtgtcatcatcctgccatacaacggcgggattgccggcaatactgattgaatcagccgtataaccagtaatcaaaggtgaatcaacagcctcaaaacgaccagtcacggccccatcatcagtcaaccaatctgtgtagacgactgtgccattaacttcatccaccgtgacgttacgaccaaaattaaccgcttgaacattgtccggtttagcagtgcgaccatccttgtataaatactgaatcgttcgactgacttgctcagttaaatcctcaaagtcagtccccactggatatgtgggtccgtttggattatcggggtcgatcggctcgcctggcgtacccggattatctggcgtgcgtgttacaaatttatgaacaagtgtaacctggtacttttgaacaatgccgtcctggtcatagactcccccggctgttggatagtcatcatcgaccaggtcgtagcccgcattctcatacgcggcaatcgtatcagccgtccgatacgcatccgttgtcccgtacgctccttgtaagggttccgtcttaataaccttgttatcagtttggtcaaaatacgttacgatcgccgtttcagtcttggccaaataacgatacgtcacggtaccgccctgatcagttaacgtgccattataggctagtccagtattgggtgctaacacatagcccgtcttgggtttggctgccgtcgtgtaggtcaaatagtccgtggccgttgcgtccgtagcatgtgtcgccgtaccagtttccgaagcatctacctgagtctcaccattagcatctacatgttcgtagaggtacttaaccgcaatatcaccaattgtcaaggtgccaggaatgactgaaatggtatagtttttattcaccgaatcatcagcatcaggagtggccgtaattgtcttagttccaaccgcactcatgccgttggtcacacgatactttaaggtctcaccattaactgtcccagtaaccaccgccgccaaattcttttgcgtcccatccgaccaataaatcttgttgggaatcgtaattgttactttggctggatcaattgtcagcgttccattgacatacgaaattttataattactggtatcggctgccgtagtcccagtcattgcataagtgccgaccgtagtataagtcgtcgcaccactgccatctgctgcaactgcggtaaatactaactgatcataattggtcccgctagtaacagtggcagtcgtgccatgtgatcggccgtcataaactgcattatcatccttgaccgtgactgtcagatctgctggcgtgatcaccaacgtcccatccgtcgtggtaacggtatagtttttagccaaaatcgccgcttgcgtgggatccgctaacgcgtatgtcaggtcgtcataggtaccgacgttcgtgtcagtcgtcgtggtaaagtcaaaatgatcatacacggttccagtcgttacggatgtcccctgaggcttgccattataggtcactgtaccactagctatctttaactcgagaccagcagcctgcaccgcaccagtcgtggtgaaaacggccgcatcatccagaatataattcgaccccagcgcagcttgaactgccttccgaccagcgtcattaagggtgattgcatatttgccagtgtccgcaccggtcaagttagtttcggtgccttgatacgtataagtaaaatctgccaacgttaaaacacgttgaccgaccttgccggctacgcctggtttagcatcgccgatttcgccgttactaatttgaaggatattttgctttgttgcatttttaacggtgactaccggcaacattgtcaatgatcccgtatacaactgtgaaggccgaagtataattagcccattcttaccagtggtggctgtgatttttacagggacaatgttaattgtaaaggtataatcggaggccccagtcgaaaaggttgggacaaagtcatccaaatcactggtcgaggtatcgtaagcattatagtcttgcataacccggctcatcccagctttacccgctgcattgatcgtcactgagtaactaccaatttggtcgagcgttgaaaagtccgtatctccggaatatttcgtgacctgcccatgttcatccgtatacacaacatcaacgtaatcattgacatcagcagagtccagaaaaagtgcatatagcaaattgaccttgttgccgtttacatcttctaagtaattgcccgctgcatcttgaatgtagtaggcgacgtcgttagccggcgtctcatctggagaactaatatgagattctagatccgccagcgtcgcctcgccatagtccatcgacacggtccccgtagttactaacgatacggtcggcttcgtttcagcttcactggtgatagctgaaaccgcctgtactgcagacttagtgaccggcgtgtttgctgacctgctcgctagcgcacccgtcaatgggagtgcccgacttgtcactgcagtcgtaatggtcggtgcttcagcagtaggtatgctggctgttttcccagtttccgtacgcgtttggctagctgtcgtagcatcagtgagatcatttgccactgatgaacttgtcgtctcagtgtttagcacatctgtgtcagcactcgtagtagccgttttagttgcggatgctgatgtggcttccgtgttagtagatttactggtgacacttggtgcactagcacttgcgccatcagtacttgatatgctagcacttgagtcagcgctacttgaagcagtaccgacttcggcagctggcttcgtagctgctgtcgactggcgattactggaagctgaagttgccccagttgaatcagtagtcgctttagtatcctgagtcgcggccgttacatcagtagcagcttttgcatcctgagtcgcggtcttagtagctgtcgccgtactagctgattttagtacgacggcattgctcggttctgccatgtcggaactaacgctagcgctattgtcggccgtgtcaacccccgtacccgttgcggctttcacttgttcaacttggctaaaagtcaaaccgatgccaactgaaaatactgtgatactagcagccacccagcgccgccccgatttataaagcttataatgagacttactttccaatcccaacctatttaaacgattccgcataattctgccctccaaagttcaaccgtacctggagcaatcaagttatttagctgagtaatatttggtgcgtttcgtaccgtgccgaaacgattgtgttaatcatcaaactatcacctaattgaccccttcaatcattagtatacgttcaaataagttgaaataacaagtgcataacaaaaaatagacgaaattatttttgagattatttaattgtagtatcagttcacgctataacactgcattaaaatactgatataaccaacatattgacacacttattttgaatctggctcatccgcatcccagttcggtacttatcaaacaatgtatagcatttgttctacggctgaaatcgtttaccagctatttagcagcaccaaacaatttttatcgcccgccaaccacatcacctaatattgttaagacgcgcagatcatgaactgtttttccacaccaaaaagcccctctgaatgggtttcattcaaaggggcacggacatgccgcacgatgttctcatttaagctgttatcaatacacttccgatgacgcccggccgcttacgttcaaaaaccatcgtcagccgactggagacggtctggtttcgctagtaacttcatcactgacacaccctaatctaaataggtactatgcatcccaatatagcctaaattcgttcccattggtttggccgcgactaatattggataaatctgatcataaaagtttgaagcagccttcgagaggcccttgttgcgtagcgcctccatttgaaaactgaccactaatttatttaacacagcaattgaatagcgatgatgctccaaatcggctttggccatcaacccgatcttacgttcacggtcggtaagattagggtcgagaacgaagtcaaccaattgactcaataacgcctgttcatcgacctgatgtttccccgtacgtccaaacatcggctttcacctaactctcttttattttatcgtgctcgctttgagcaatctcccgtttagttaacccggccgccagcttagcactagttatacacgtcaggtacgcgacaaccctgttcaaataaatcagtttagtctgatatcaagtgattcatattcagctaattgacgcatcccaagaagcattgcgtactcgtattactatcataatacttcaaattaggaattacgagctatctcgtaagattgttaaattataaatccaagcacagcatgctcacattgtgaaccgacctaaattggtcgatgatttgacgattgagcgtgtcactaacttcgccaataaaaaaagctagctaatcattaaaaatgattaactagctttccatcatcagctcagcctaagctgcaaccgatgactgttgacgttgtgatttagccacgacgacgttctgggatccgagcagccttaccatgtaagttacgtaagtagtataacttggcacgacgtacacgaccttgacgaacgacatcaattgcggcaacgcgtggtgtgtgtaatgggaatgtccgttccacaccaacaccgttactgatcttacgaacagtataagtttcgctgataccggaaccatggcgcttgataacaacaccttcaaataattggatccgttcgcgagtaccttcaacaactcgtgcatgaacacgaactgtgtctccagcacggaaatcagggatgtccgtacgaagttgttcattggtgatcttttcgatcaattggttttgacgcataatgtatttcttcctttcgccgacattcgtgacaacctggtcagcggaacatcgttaatgggcacaatagccaataaatagaataccatattcgagggtgggcacgcaagtttttttgaactcttcacgactaacttgtcctaattaacggcatagcctagacttccgactcatccgccttgatatctgctaacatctgtttagcttttcctgacaatgatagccccgtcaacatgtccgggcgccgttcataggtccgtttcagtgcctgttctaagcgccaatcatcaatttttccatgatcaccactcagtaagatatctggtaccttcataccacgaaaatcagcaggacgcgtatattgtgggtattccaggagaccgctcgaaaaagaatcccccggagccgattccgaattgccaagcacacctggtaagagccgcaccgtcgcatcaatcatgaccattgcacccagttcaccaccagttaaaacgtaatcacctagcgagacttcatcggtgactaatgaccgaatccgctcatcataaccctcatagtggccgcaaataaaggtcaagtgttcttcctgagcaaagtcttcagcaacgtgttgattgaactggactcccgccggatccaataagatcacgcgaccgggtgccgggtgtttttcctgaacgctggccaaagcatcaaaaattggttgtggttggagtaacatgcccgcaccaccaccatacggataatcatccacatggttatgcttgtcggtcgtaaaatcccgaaaattagtgacatcaacattgatgacgtcattttcaatggcattgccaatcatcgactcatgaagcggccccgcaaacatctctggaaacaggcttaaaatatcgatttgcattaatcaatcagcccttccattagttcaacagtcaccacgcccgcatccaagtcaacatctttaatgacctggggaatcttaggtagtaagacgtcagactgaccatgatcccgtttgaccacccaaacatcattcgcaccaggtgacagaatctctttaatagtccctaaaggctcgtcagcggtcgtcacaacttgtaggccgacaatttggtgatagtagtactcacccgctggtaaggcatgtaatgcttcagcaggaactttgatcgtccaccccttatagcgctccacatcattgatgttatcgagcccttcaaaggtaagaaagtacagtcccttttgctcacgggccttcgcgattttgacagtaatcccgccagtcgtttcatctggggttttaaataaactcaattgttgccctactttaaagcgttcttctggaaaatcagtcacgacaacgactttcacttcaccacgaatgccgtgggtgttaactagggtgccaacacgatagtaatccattagcttcctcctcttaattagcttgattgttattcgttttaaatgtcatcaacatgttacaactaatctactcaacgacggtcatcgagatactttgactcgtcctcaaaaaccggaacaagatataaaaaaactcttaaacaaaacatcactgcttcgctcaagagtttttttgttgtccgtcttcgatcgtaagccggacacgtttaggtcctgaaactcggacactatacacaattgtccgaattgccgaagcaacccgtccctgccgaccaatgacccggccgatatcttcgggattaaccgttaagttgtattcaagataacgcgtggtttccttaaaatcaactttaatatcgtctggatattgaactaacggggtgacaaccgtggtgattaaagctttaatatctgccatgatctattaccgctttattatttagtgaacttagcttcgtggtacttcttcatgataccggccttagataagatattcttaaccgtatctgaaggttgggcaccattgttcaaccaaccgaggatatcttcctcttcaagtttaacttgggctggttctgtaagtgggttgtatgtgccgacttgggcgataaaacgaccatcacgtggtgaacgtgaatctgcgacaacaatccggtaaaatggatttttcttagaacccatccgctttagacgaatcttgactgacatttaaacacctcccgaattctttaacaggtaataatataccagtaaatcaatagcttgtaaaggactttttcttgacaggctaaaaaaacttataaattagcgtttgcgacgccgcattgctttggctaagcgcttttgttttttcttcttagtttgacgaaccattcgcttcatggccatttgttgcatcttaccaccgataccaccaccgccattggcaccacccatgagaccttccataccagcaaagttccctttggacatttgattcatcatctttttggtctggttgaattgcttgatcatccggttgacttcatgaattggccgcccggaaccagccgcaatccgtcgacgccgagatgggttcaacaaatccggatctgctttttcggcattggtcatcgaataaacgattgcccggatatgggcaatgtctttcgggtccatgttgatatttttcatcgctggattgttagccatgccgggaatcatcttcatgatatcttccatgttccccatcttgtcaacttggtctaattggtcgataaagtcattgaagtcaaaagtgttttcctgaatcttcaggttcatttcttcggcttgtttttcgtcatattgctgttgcgccttttcaatcagcgtcagcatatcacccataccaagaatccgatccgccatccggtctggatggaagacatcaagatcagtcatcttttcgccttgaccgacaaacttgattggcttaccagtgacggcccggattgatagtgcagccccaccacgagtatcaccatctaacttcgtcaagacgaccccggtcacatccagcttatcgttaaagccctccgccgtattaacggcgttttgaccagtcatcgcatcgatcactaacaaaatttcgtcaggatgaacgagatctttaatattggccaactcgttcatcaactgctcatcgatttgtaaccgaccagccgtatcaataaacacgtaatcattgtggttttcttgcgcctgtgccatcccttgacgcacaatctcaacgggatcgacatcggttcctagttggaagactggaacgtcgatttggcgaccaacttgttgcaattgttcaatcgcggctggccggtaaacgtcggccgcaatcattaatggtcgggcatcctgttcgttctttaatttgagggctaattttccgaccgtcgtcgttttcccggccccttggagcccagccatcatgatgaccgttggaatcttcggcgatttgttcagtggaactgccttttcacccattgttttcgttaattcttcatcaacgattttaacgatttgttgggctggatttaaaccttccagcacctttgcgccgagcgcacgttcgcgaaccgttttaacaaaatccttgaccaccgtaaagttaacgtcggcttcaagtaatgctaaccgaatttcacgcatggttgctcgaagatcactttccgaaatcttccccttgcgccgtaaattggtcattgctttttgtaaacgttccgttaggccttcaaatgccattagtgtcacctaacctttattattattctgagtcagcttccaagttgactagttgttgaatcatcttaattaactgggtatccccatggtaattttgcttaatatagtcagagatcgcgtcaacttcgtgattacgttccacaaagtcgtggtagagatgcagcttagcctcataaccttctaaaatcttttcggtccgcttgatgttatcatagacggcctggcgcgaaactgagaactccgctgcaatctcgcctaaggaatagtcatcagcgtagtacagttgaatataggctttttgcttattcgttaataacggttcataaaactcgaataacgaattgattcgataatttttttcaatttccatgtggggactcctcacgcttatcatacagactacacactaaataagagtaccgattttatcgccattcgtcaactatcagtcgctatttgtggtaaaaataaatggtaatcgtcctcgtgctgagaacaattaccattcgttaactggctttcaatttaagaccatcatcaactgatttaacccgtgataatatctttaaataacccgtagacaaagtcattggcattgaatggtcgtaaatcagtcaccttttcacctaaaccaacgtactttacagcaagatgcaattcattacgaatagctaagacgatcccaccacgtgccgtaccatcaagtttagttaacacaatcccactgacatccgtcgactgtttaaacaatttggcttggttcagcgcgttttgcccagtcgtggcatccagcaccagtaagacctcatgtggtgcatcagggatttcacgggtgatgacccgcttgatcttttccaattcattcatcaagttgactttgttttgaagccgaccagcagtgtccacaaagagcacgtcataatcttcggccttagccttcttaaccgcgtcaaagcaaacggccgctggatcacttttttcggccttagcgaccacgtcaaccccgtctcgttgcccccagacttgcaactgctggattgcaccagctctaaacgtatcacaagccgccaacaagaccttcttgccttgctgcttgtacatgttcgccatcttaccgattgtagtggtcttaccagcaccattgaccccgacaaataaaataacggttggaccactcttagccatgtgaatcgagttatcctcgccttcaccagcttcaccgtacatatcaacgagcttttcgacgatgacgcttgagatttctttcttgctcttcgcgttctttaatttaacttcgtcacgtagctcgtcactaattcgcatcgcggtctcataacccacatcagattcaatcagcgtatcttccaaatcatcgaagaacgcttcgtcgacatggcggaaattagccaagaaggcattgatacgatcaccaaacgttttccgcgactttttcagtccttcatcataacgttctgcctcagttggctccggctcagccgattccgaatcagccgccgcattaacagtcggtgcggcggattcagtcgcagtcgtcgctgatgacttgactgctggcgccgtactggctactgattctgacatagcgttgccttcaactaccgcatcagacttagtcgctaacgccacgtcgctcgcggccgcttgactaacttgtgccgcactcgcacttaatgcagctagtgactgggcaaccattgcactggctgtgagtggcgcttccgacaccgtcgccgattgcagtgatgcttgtgaaccagactgtgcactcactgccgccgtgctatcggccggggcttcactagtagctgccgattttactgtcgctggttcgtccgcagtgcttgtcgcttcgcttacggctgtactggacaccggtgtcgcagttgattcagttgttgcgccctccgagcgagctggctgttgtgacgaaggggcccggtcgtcactgaccggtgcgttagcttgacttgtcgttgctggcgcttcactggcagctgacgttgtttgagcgtcatctgattctggtaaactaaacgctttttttaaccgactaaatagtcccatcttcaacacttcctttaattatttttgttcatcttttaaatctgccaaggagactgagaccatcttggagacacctgactcttccatggttaccccataaagtacgtcagcgtgcatcattgttccttttcgatgagtaatgatcacaaactgcgttcccgtttgaaaatcattcaaatactgactgaaccgatccacgttggcatcgtctaacgcagcttcggcttcatctaagatactgaatggcacggggcgcactgctaaaatggcaaataataacgtaatagccgttaacgcccgttccccaccagaaagtaagcttaatcgctgaaattttttgcccggtggctgggccatgatatcaaccccactggtcaataaatgttctgggtcggtcaagatcaattcagccttaccgccgccaaacatctgttcaaaaatcgtactaaattcgctagcgacttgatcaaatgccgttttaaagcgggtggcaacggtcgtatccaaatcagccattgtttgcagtaagtgttccttggcttcagttaaatcggaagcttggttattgagaaagtcaaagcgttccttgacccgctcgaattcgtcaatcgcgccgaggtttaccgttccaatctcatccaagccccgtttaagcagtttcaactgttctgtaatcgcaggtaacgctaagtcactgacgtcagcttgtgctgcggcaactgtcaactggtacttttcagccagatcagccgtggcgtggtcgacttcgccagtcaattttgtttggcttaattccaagcgacggtaatcatccgttgcggccgctgcgagttgttgcaaccgaacttgctgggtcgataattcttcaacctgatcattaagcgttgctagctgttgttcacacgttttccgttgttcttcaaccgcagcctgtttagccttagctgttttcaagaccgtatcgcgttctgcgaccgacatttgctggctcgctaacgttgttttaattgctgttaaatccgcttgaatttgctttttcgtctcttcattttgcgccaaggtcgcctgacattgttctaattgtcgttgcgtttgtttcacgtgttcctgcaacgtaatcagttgttcacgctgggcttgtaatttcgtcgtttgagtctgttgataactttcgtaatccgtttgctgttgttggactgttttcatttggtcctgatagtctttaagcttagccgcattagccgcttgcgcttgttgattacgagccactaagtcttcatagctatcatcagcttgcgtctgttgctgctcataagttaaagccttaacttgacgacttagctgcgtttgctcgctctgtgccgcctgtaactgggcctgtgtctgactaaggcgatccttaagttcacttagttgttggcgggtcgtttcaacctgaaccgtcaagtcttggttagcttttttaaggtctgctagcccttgttcataggttactaattcagactgcatctgggcaacattagctgcaattttttccgcggattgttgctgttggagtagcccattatcatcatggcgagtcgcaccaccggtgatggccccactggccgcaatcgtttcaccatcaatggttaccaatttgcaccgaaaacgtctgctccgtgaaattgccatcgcgtggtctagcgtgtccacaatcgccgttgttcctaacaagtaacgtttgattgccgtcaatcgtgattcacaatcgaccaactcgctagccacgcccaacacaccaggttgttgtgataaatcgcgctcagtgttaacgggaagttgacgagctgtgatccgctcgataggcaaaaaggttgcccgaccggcgtgattttgttttaagaaattaacaacagttttagccgtctgttgtgtgtcacaaacaatattttgcaactgtccgcccagcgcaacttcgaccgccttagtatactgatcaggaacggtcaggagttctgaaacggccccggcaacgccactaaactgttggcgatgttgtaagaccattcgaacgcccgcataaaagttcgtatagcgttcctgaacagcttgcaacgcctctagccgtgacttttcacgctgcatcaagccagccgcgtctaaccaacgttgctgttgctcgtcgatccgctctgcattcgtttttacttgggcttgttgggctgttagcgtggcctgctgctgattaacttgattttctaaatcacgttgctcacgattgtgcacgtctacggtcgtctgcacccgtttcaagttagcctgagcctgtgctagccgttctgctaacgctgtgctctgactgccagactgttgatgttgcttaacgaggttcttcgcttcgttattcagttcagcctgaacttgtttttcatcaatataagcattgcgtaatttttccagctcatcagccaactgctgacggccggccgcactcgttgccgtcgttaactcggcaacttgcgctttgactgccttaacttgggcttgctgctcagataatgtttgttctaattgggtttgttgctcggtttgcgtcgcaatctgttgctcagttgcggtcaaactggccgtcagccgttcctgctcagactgttggttttgccgccgttcagcgtcaaccccttgttgtccttgcgtgttttcgatggtcttaatcagctcaagattttgtgctaccagctcatctttttgctttaattgagctgtctgctgggtttttaaattagctagcttggttgcaccagcatcaacttgttgctgatacttagccactaacgccttggcactagctaacttttcattgacaccttgtagttgatcacgagcaatcgtcaacttcttaacgagccgcgaacggtccaaataatcaaatttttgtttttgatcttgataatcccgggcaagactcgcctgttcttccaacggccccttttgctgattcaattcagcaatgatatcgttcacgcggtctaaataatccgtcgtttccgctaatttattctccgtcgtgaacttatcctttttgtactttaagaccccagcgacatcttcgataatgctgcggcgctcttctggtttcgcattaaagaccgcctcaacacgaccttgagaaatcactgaaaatgagtcttttcccagaccagtatcaatcatcaaattcgtaatatctttcaaccggcaactctgattattaattaaataatcgctgtcaccgttacgaaagagtttccgcgtaatactaacttctgcgtaatccaaaggtaaaaagtggtcactgttatcaaacgtgatcgtgactttagccatattcaacggttttcgattagccgagccggcaaaaatgacgtcggtcatcttagtgccgcgtaaacttttgacggcctgttctccgaggacccagcgaatagcttcaataatgttactcttaccactaccgtttgggccgacaatccccgtcattccggcttgaaaatcaattttggttttatcagcaaatgatttaaatccgctgatttctaatgatttaagttgcattcgacacaaacttcctgtaattattaatggttacttttgctgtaattgtgaataagcttgccgagcagcgctctgttcggcttccttcttggaatgcccccagccctcaccgattttttgaccatcggcaagtacggcaatctcataagaccgctcattggctggaccatcttgttcaattaattgatagtcgattgcgacatcgccatcccgttgcaagtattcttgcaaggtcgtcttataatcaaaaacgccatcaaaacgaccctcatccagcttaggaaaaattacttgatgaacgaacttcaaaacaggttcccgtccttgatccaggtacagtgccccgacaaatgattcaaaaatatcacataaaagtgaatctcgttcccaagcatgcgctttttgttcgcccttgcctaaccggatgtactgaggaaagtcacattcacgggcaaagcttgcaaaactttcttcacaaaccatggcggcccgtaaacgagtcaacttaccttggggcatgtctttataacgtttgtataaatattcggacaccactaactccaagacggcatcccccaaaaattcgacccgttcgtaatacttcaactgttggtcctgatgttcattgacatacgaggcttgtgtaaacgcctccgccaataaatcgggatcgttaaacacaatgccaaaccgttccttcaacattgcagctaattctgtaatcatttgaaacttcctttcgttatcattctatcgactaaccccattggatcagccagttatcacaatctgttactggtggtgcctaacttagcatgaatcattatttaaggtggtcattcatctgccgttcgagtgcttccgacatgtattcagtgctactcttacacgcaatgttcagtttcacccagccgtggcaatcgaccgtggatgatcagaagccaacaatatagaaacacaagttaaaagtccgcttaagtaaggattcatctgataatcagtcagtcaacaggtcacacattgcatatcataacattatactatgatttagtggtcaataacaatgatatcggtactttcgtagtcagacaagcaaaaacaggtaaccatgttggctacctgtttttgcttggtcaattaacttattttgcttggtgcgctgccacgtaatcgacgacttcgccgaccgttgacaatttttcggcatcttcgtctgagatttcgctaccaaaggtgtcttctaattccagtacaaactcaacaaaatcgatggaatcagcatccaaatcggtttgcaagttcatttcgttggtaatcgttgctttatcaacttcgaaccgatcagcaatgatatccgcaattttatcgaaaatttcttctttcgtcatgtaaagatccctcactaacttgaattcactaaagtattctaatcgttttcagcaggaatgtctacacttgcttgctgattagcttgttgattagcaaaatattccgcaactcctgggacgatatccgtactgaccatctggcgaatttggcggatagtattcacgattgttggcgctttgctggaaccgtgcgtcttaacgaccggcgccttcaatcctagtaagaccgcgccaccgtactgagaatagtccatttgagaccggatttcattaaacccattcttaagcaataggccgcctaacttgccactgataccggtgtcatagacggcatctttcactaaaccgagcatggaacgcgccgtaccttcaatgctcttcaaaacggcgttacccgtaaaaccatccgttacgacgacatcagcaaccccgttcaataagtcccgggattcaacattaccgacaaaattgataccgtcagtctgtgacaagagttcaaacgctgccttatggaccttatttcccttgtcatcttccgtcccgttattgagtaaggcaacccgtggatgcttagcttgcatcatccgttctgcatagtacgtccctaacacaccgtattgttgcaagttcagtggcttactatcagcattagcaccaatatccatcatcacaaagttcgattggttagcattgcgtaccactggcaataccgtcactaatcccggtcggtcgatgcctttgatccggcccacgataaataacccggccgccagaacggcccccgaattaccggcagaaaagaaggcgtccgcctggccatccttcacggcctgagccgccattacgattgatgaatgcttcttacggcgaacggcacgtacgggttcatcctccatcgtaataacttcatcagcattgatgatttgaatccgatcacggttcttcagttgcgcgttaatcacatcgcgttgaccatataataaaaagaccgtatcctcaaataaatcacgagcctgttcgaccccctcgatcacagcgttaggggcgtaatcgccacccatggcatcaatcgcaattttaatcattgtgtcaccattcctctcatcacagtactgtatttaggttattaatcgagcgtccccaccgcagccaacttctggctcaaataggcggctagtgcccgattatccggttgactttgccaatccggttgctgtacgattgcgtgggcatcttgctgggcaacttgtagcacggtcaaatccgcaatcggatcacccactttaaattccggcattcccgattgcttgacacccagcacatcaccggctcctcgtaattctaagtctttttgtgccaaaacaaaaccatttgttgtctgcgtcatgatctgcatccgctcaatcccttgctggttcttgggatcagccaccaaaatacagtatgaagccttggtcccacgaccgacgcgtccgcgtaattgatgtagttgcgccaagccaaaacggtcagcatcataaatcatcatgattgtggcattcttgacgtcaacacccacttcaatcacggtcgtggaaacaagtaactgaatgtctcccgccttaaaagccgccatgaccgcgtctttttcctcaggtttcattcgaccgtgcaacagtccaactttaacactcgccccaaaatactcttgtaaattagctgacagagcctcggcgtttttaacatccagcgtctcggattcctcaatcaatggtgtcaccacataggcttgcgatccattgtcaatctgttgatgaacaaagcttaacgccgaattagcttggttgctccgtacccaagtggtttgaatcggttgccgaccagccggtaattcatcaatttcagaaacgtccatttcaccatacgccgtaatcgccaatgtccttggaattggtgttgccgtcatggctagtgcatcaggttgcccgcctttttgacgaaaggcggcccgttggttaaccccaaagcgatgttgctcatcggtaataactaatcccaaattagcataagtcaccccgtcctggatcagggcgtgcgtgccaatcaataagttgatctcaccagcagccagcgctgctaacaatgtcttgcgggcagctggcttggtcgcacccgttaacagtgcgacgttgacatccgtgtcggcaaagacctgggccaagttatttgcgtgttgttcagccaaaatttcggttggcgtcatcaacgcggcctgataaccagcggtaatcgccgcatacatgacaatggcagccacaattgttttcccggaccccacgtcaccttgaagcaaccgattcatatgcttcggtgacttcaaatccaaacaaatttcattgacgacacgtttttgggcgtgggtcaattcaaatggcagtgttttaataaacgcctttagtcggtcattgtcataagcgatcgcaataccgttcgtcgtcgcgtccgtttgcttcagaacttgcatttgcatttgaaacaacaagaactcctcgtaggtcgctgagcgtcgagcggccgttgaatcggcttgactagctgggaagtgcatatcatgaatcatttggcgccgcggtaacagtcggtatttagcacgtaagttagcaggcacaatgtccgtaatgactggggcatataactcatatgcttgtttgatcatcttctgaatcgtcccctgcttgaccgtcttgctggccggataaatcgaaccaaacgctgaatccgcattattgggattgatgatcttcattcccgtcaagctactgcgcgtggcgtcccacttgccataaacggctaaatcttggccagtctcaatctgtttcatcaagtatggttgattaaaaaaagtcaccatatagacgtcatggtcgattaacaagcgaaaattcaggcgattcttcttacggccaaaccgtgctagcacaggttcagaagccacagtaccctttagtgtcaccttttcttgatcggcgatttcattgacgtctttgacctgtagatcttcatagcgaaagggataataggtcaatagatctgcaatcgtattaatcccaagctccgctaaacctttttggcgggctgggccgacaccacttaaagttgcaaccgcgtcactcaactgttgtcccatgcctgaccaccgccctttctaaaataattgcctttaccaatattaattataccaaaaaaacgtttcaatcccgcgggaagtatccgtccgtacaaaaacaggccccagcatcactgctaagccctatttttaacggttagtcctattcaactgacacaaggaatgggtaaactggttggtcaccttcatgaatttcaatttctaattcatcatccaactcttgcaccttagctgccaaatgatcagcgtcagttttagttgcatccttgccgtaaataatcgttacgagttcgctatcttcgtcgagcatggctttgaccatatccaaagcagcggtatcgcgatctggattcgtaattacgattttgccatcaactaagcccatgtaatcatctttcttgatttcaaggccatcaatcgtcgtgtcgcgaacagcatgtgtgacttgaccactaacaaccgtactcaaggtttcttccatcgcggcctgattatcgtctaaatcagcttcagcattgaatgccaacattgcagtcatgccttgcgaaatcgtctgactgtggataattttaactgggacatcggcaacttccgcagcttgttcagctgccaaaaagatgtttttgttgtttggcaatactaatgcttgttgggcaccactgtcattaacagctttgacgatatccgcggtacttggattcatcgtttgaccaccagcaatgatatcggtgacacccaagcccttaaatagcttgccgatcccatcacccgatgacacagagatgatcgcataaccatgcatgtcaacttgtggttgtgaaggtaaggcgggctcagcagcggcttgcgcttcgtcttccttatcatgttccatgatggtttcttgttgtagacgcatattatcaactttaactttgatcaacgccccaaaacgttggccccacgtcatgacatcgccaggatgttccgtatgaacgtgcaccttaacgatttcatcatcgttgatgacaagtaatgaatcgcccaattttgctaagtactcatagaaagtgtcatagtcgaacttgtgatcaactaacttaccatcgccgattcgcaccataatttcggtacagtagccatacttgatatcattcgggtctaattgcccctgcacactttgatggtgggcagcatcaatcatcgaatccatttcagcatcgtccggaacatagtcctgtgattcgtcgaccttgccgcttaatgagtcactaaaggcttccagcacgaaggtcagcccctgaccaccggaatcaacaaccccaacttgttttaaaacgggtaacaagtccggcgtggacttcaatgcagcttcagcagccgtaacgacggcatccataacttcacaaatatcatcggtcgttttaacagcttccttaccggcaccagcagctttgcggatgacagtgaggatagttccttcagtcggcttcataacggccttgtaggcggtctgagcaccggctgcgagggcggctgctaaatcgttagcggttaagctctccttatccgctacggctttagaaaagccccgaaaaatttgtgatagaatcacaccagaattaccacgggcccccatcaagagtcccttggctaaggctgacgctaggtcgcctacttttgtactggtttcttcacgttcatatttggcaccgctggccatcgataagctcatattagtcccggtatcaccatctggtaccggaaagacgttcaaagaattaataaattcagcacgttggttcagcttttgtgaagcagcctgcaccattttgccaaattcaagattagtaatcgtggtgattttcaatttcaaaattcctccttggcttccaccaacatcaatttagtcgttcattacccggacaccttggacaatgacgttgaccgaattggccgtaacgccaagcatgttttgtaagttatatttgaccttggcttggacattgcgtgagacttctgaaattttggtcccataactgacgataatgttgacatcaatagccaccccattatcctcttggcgaacaaccacaccgcgcgcatagttttcgcggcgtaaaatttcattaacattatcacgaatctggttccgactcgccataccgacaaccccgtagttatccgttgcggcgccaccgacgaccgtcgcgataacatcattatcaatatcaatggttccaaattgcgttttgattttgacagccatgaaaatagcctccttgttttaacgcgttcatttacgatagtttatcatagcacaaccactcttgaaagaaaaattaagcgactgcttaacagaagcccggaaactgggaatttagcagtaaagtaaaattacttgatagaaatgtattgcaacctttattaatctatgataaattattctagtgaatgataaagacgaccttttatcaatgaattaccgaaggaggcagatcaacatggcaaaagactacgttacaggcaaacggacgcactttggtaacacgcgttctcacgctttaaaccacagccgccgcagctggaaagctaacttgcaaaaagttcgcattttagttgatggtaaaccaaagaaggtttgggtttcagctcggactttgaaatcaggtaaagttacgcgcgtttagcgcagcaaatcgccagcacatttttttgtggctggcgttttttgttgtctaaaattactaatttctcgtcaactttttataaagtttataattcagccttgaccagcccattatgatgacctgaatcattgagggtgcttgccgtaccatcgtcggaaacaaccagctgggtctgaccaaaaagttctgcttcaacataagctttccggttaggtctactaacgaccaccgacctaaacatcagcacgtttcaccaacaagctccccgatgatacgtcgttactgcatattaaaagaccggttgatgagtttatgactcaccgaccggtcttattttagctgaaacctttgggtaccctacgcatccgccatgctgtcatcacgactttgaataacagctagaacccccgcatcaaagctaaagtgaccagtattgccactgaattcgttactggcccatgaaatcgggtacgcattataagcagcgtccaactgatacttctcatcgggtaacgtgagatgcatcggcatcagcggtacaaacgccaaatagcgtttatccgcttccttcgtaatctggtagtcccctggtagaaagaaccgaaccgaattttgcttatcaatcagtttgatctgcggagcccactgacgaaataccggatcaagtactaaccacatattggccagtaaatggtctaaccgaccacccgtggcaccatatagatgcacttcatccggttgcaactgctcgaaaatggatttaatcgccaattgtgtatccgtatggtcttggtcgggtttgacaacgacagcgcccaccaacgcatctttgacagtctggagttcagccgcatcaattgaatcaaaatcacctacgaccatcacgggctggataccacgtttcaccaaacgcaacgcgccacggtcagcgccgacccatggtcctggaatcgtcgttaaatctgctggataattagcggtcggtccgccaaccagtaagtttacgatggttgccattaattggtcgccaccttcaaatcttgaatacgttgcgctgggtccgcactgtcatagacatacgaaccagcaacagcgaccgtagcaccagcgtcatagcacgccttgacggtctggtcgttgattccaccatcaacttcaatctcaaattgataaccgtgttgttgcttcaattcgttcaacgccgcaattttagcaaccatttggtccagaaaatgttgaccaccaaaaccaggattgacggtcataatcaaaacttgatccactagtggcaataattcactaatcatgctgagtggtgttccggggttcacgaccacttcggctttcacaccagcatctttgattaattgtaaggcgtgataaatgtgacgggtactttcaacgtgcacaccaatcaaatctgcaccggcctttgcaaactgcccaacaaaccgctctgggtccataatcattaaatgacaatctaacattaatgacgttactggccgtaaatccgccacagtactcattccgaatgacaagttggggacaaactgaccatccatcacgtcaatatgcaacgcatcggcaccggcattttcagccatctgaacgtcacgttgaaggttcgcaaaatctgcacttaaaattgaaggggcaactttaatcattagtctcactcactttttcttattatagattacttttttatttttaatggtttcatagaattgtaaataattatcatagcgacttgctaacagctccccagctgccaatgcctgtttaaccgcacattgcggttcgttaatatgcacacagcctcggtatttgcaatcagcgctaagtcgcacaaactctggaaaataatggggcaactcgttagcggcaatatcgaaaacttcataggatgagaaacccggcgtatcagcgaccaacccatccgcaatcgggatcaagctgactttacgggtcgtatgtttcccacgattcagcgcctgcgagatttcaccagtcgctaacgccagccctggttgtaaatgatttagcagtgttgacttaccagcaccagtttggcccatgacaaccgccacatgaccagccagagccgttttaactgcggctaaggcggccggtgaaaatgcggttcgttcgcagatgacctggtaaccaatctgccgataagcgtccgctaatgttaatcgttgttggtacacctcatcggttagtaaatcagtcttcgcaaagtagagtaatggttcaatacctgccactgccaaagctaccagttgtcgatccaataaattcgttgaaaattcttgttccgttgtagcggttaccacgatacctaaatcaacattagccactggcggccgtaccaactgggtctgtcgatcaagaatatttaacacgtagccctcttgtggggtcgccgcatcaaactccacattgtcgccgacaagtggcgtaatccgccgcttccggaaattcccgcgtgcacgggtccgatacatttggccatcagcataaacgtcataaaagccgcttagcgattgccgaatttgtccaattttcaaattagcaccaccttttatattatttggtacggtccacttttctctattgtaccaaaaaagtcatgcattgcgcatgacttatctttattttgttgcatttttgcttgtaatattcttcttttccatgatcgtaaccccgttacgcacgattcggtaatgccccttcgtattaccggtcagctgaaacggtaaactaatcttagtcgaccgcatgattgcaatatcgcgataaacggtctcaatcatatgggtatcatcatacaaataaatcttaacatcgttggcctgggcagtggtggccgataacgctttgtatggcaccgttagtttaacataaaaattctgtggtgtcgtcacgttattatcactgccccttgacatggtcaccgtaatagtcgacccagtccggacattgccaccgccatctggatcttgatcataggaataacctgccttctgttccgaagagtagccctgcttaaagttaacattaagatcatttgcctcagcatagtccagaatatcgctcttgctctcaccagttaaatcttttagctcgacgtagcggctaccagcgctgaccgtaaacgtcaccgtcgtatctgtcggcatcacgcgactaccagcgacaacatcctgactgatgatttgtcctgctgcaaccgacgacgtactgtaagtttccttaactttgaatcccgccgatttaagcgtctgtcgaacatcatggtaattatcattgacataattaccaaagctcataaccttggcaccgttactgataaccaaattaatgcgagcacgttcttggacccgcgtcttaacactgggcgttgatttgatcacctgatttttggctacctgattacttttagcatgttgaacagtcccgaccgtgagatggtgttttttgaggaccttagttgcggcacgctgacttaagcccgttactttcggcaccgtcgtcatctgtggccgacttaattccaaaccgacgatcacggccacgactaataacaaaataataccgccccaaaagaggagccgacgccgcaacggatgtcgtttggaccaagaacgtgttggtaacggttcttcatcagcatctgtctgactctcagtcgtttcagccgggcgctggagtgttggttgcttgcttttatgcgccacgacctgggtcttaccgtcttgattggccgcaattgctgcttgaatatccgcactgggcatgatcttagtctcatcattaccgacatcttgcggtacaaagcgcttttcgcccgcacggttactagcaagcaccgtcaataagtcagcggccatgtcctcgaccgtagcataacgttcccgtggatctttcgttgtcgcctgcaagacgacgttttcaagtgcctgcggaatatccgcatcaaactctcgcacggatggcattgcattttgaaaatgctttaacgcaatggaaactgccgtctcacccttgaaaggaactgagcctgttaacatctcatataaaataatccctaacgaatagatatccgattgttttgtcgccatgctaccgcgggcctgttccggtgacaaataatggaccgaacctaaaatcgtgttagtctgcgtcatggtatgttcagataacgcgaccgcaatgccgaaatcagtgattttagcattgccctgctcatcaattaaaatattttgtggttttaaatcccgatgaataatattatgcgcgtgggccgttgccacggcacttaatatctgctccatgatgtcgattacttgctgtaacggtaacggaaagttctctttaatataatttttaagatccatccctttgacgtattccatgaccaagtattgcatgccattttcttcgccaatatcgtacaaactgacaatgtgggggtgaacaagttccgtcgttgccagtgcctcacgttggaatcgcttgatggtcttaggatcatcacgtaagtctaaccggagcagtttgaccgcaacatcacgatctaatattaagtcatgtgccaagtaaacgttggccatcccaccttcacctaaggaccgaacgatccgatatcgtccgctaagggtatagttgggtgtcatttactggccacctcaccatcaagcgccatcagcagcgccgtaatgttatccttaccaccagctgcattggctaatttgatcaacgtctcacacttctgggtcgaagtctgcgtcgttgccaaaaccgtcgcaagctgttggtcagtcaccatattcgtcagcccatctgaacataataacaattggtccccaggttgtatctggtaaaggttcgtatcgatatccgcatctggtgagatgcctagtgtccgcgtaataatatttttctgcggatgttgtcgggcctgttcggctgaaatctctcctcgcttgaccaactcattgactaaagaatgatcctccgtcagttggtggagttgcccatcgcgaaaaagatagccccgactatcaccaatgttagccatcaaaaacttttgatcaaaaagcaaagcggcgaccattgtcgtacccatgccgtttagatctgaaaattcacgggccttttcaataatatgctgattttcatcttgaacttcacttgctagccacttgacggcatcattgggttccttgaatgttgtattttcaaaccgaaaacccatgtgcgagactgccatctcggaagcgacatcgcccccctggtggccaccaataccgtccgcaacaattgcaaaattgatgcccgctttattttgaaaaaagccgacatagtcctcattttcttcacgttgttggccaatatccgaccggtatgcaaaatccattgtttaccactccaccattatttttttcgcaaacaagcaatgaaaaagccgtcggataaataatcatcgggataaatcgacaaagtcttttccgttcgatcagttttcaagtctcgttcagttggcgttgtttgcagctcaaaatctgggtgatccgctaagaatttggtaatcacatcctgattttcctgttgcaaaatcgtgcacgtactatacgtcatgataccaccttttttcaaggttggggcgaccgctgtcaaaattgccagctgaattcgttgcaagttcaaactatcctgcaactgtttctcatagcgaatctcaggcttccggcgcatcaatcccagtcccgaacacggagcatcgactaaaattcgatcaaaactttcagcattaaactgcgtctcaactttacgggcatcgagttcggtggcctcaacgcgatcagcaacgtgcatgcgcgccgcattttgaccgatcagtttcactttattggcatgaatatcaagggcaacgactgtgccaccctgctcagcatctaaactagccgcaatctgggtcgtcttgcccccgggggccgcacaagcatccaagactcgatcattcggctgcggattgagtgctggcacaactaattgtgcactttcatcttgaactgtgaacatgccataccgcatcgcttcagtattaatggcctgaccatccgttgcaatcagccctaacggtgagatttcactcggcgtaattgtcaaaccatcattaatcagcgccgttgtcacatcttcaaccgtcgacaaggccgggttgacacgtaaggcttgcttagctggttggttcaatgatgataagattcgctccatcttttcagcacctaattgacgccgcaattcttgaatcaaccatattggcatgctataagtcacactcaaccgttcatcaggatctttaatcgcatcaaaactcggtagtcctgagcgatccatttgatgtaagacgccggttacaaaccgccgaatgccagggtgacctttgaccttagcaatttcaatcgtttcgttgaaaacggcccgttgtggaatcttatccagatactgccattgatacaatgcgctcaataagagctcccgtacccaggggtcaatctggtgcggatgtcgaacaaacggggtcaaccagtattcgagagtcaaccgatgttgaatgacaccgtaaaccatatttgtcagcagattaatgtcacgccgatccatctgatgatcattgattaactggtttaattgcaaatttgaatatgcaccgttcttaatcttcgctaaggcggcgaccgctaaccagcggggggtattaccaactgtactcatttattaataacctgctctccggtagcgaacttatctgccgccccatttaaatagtctgtaattgtcatcttcggtttaccagctggctgcaactgattgattgcaatcgctgtgtggtcagcagctgcaatcacaagctcatgtttcgtcttgcgaaccacttgtccaggagcttgcgtgaccacttcgtcagctaagggggtcacatcccagaacttcgtgcgctttccatccaagaccgcataggcgattggtgctggccgcatgccccgaacttgattatcaatttcaacggccgtttttgtaaagaagtctaaaacctcttgttctggccgaatgttcggtgcaaaggtcacttgggattcatcctgtggcaccgccgtaatttcgccagcaatcaacttgggcaacgtttccagtaacaagtcgcgaccaactaagctcaacttatcaaacatcgtcccggtgtcatcgtttttttcaattggaatcgcacgctgcgccagcatatcgcccgcatccatctttttaaccatgtaaatgatagtaattccagtttcagactcaccgttgataattgaatattgaacaggcgcgccaccacgatacttaggcaacaacgagccatggacattaacggcaccaattttggcagctttcaacaattttgttggtaaaaactgtccaaaggcggccgtcacaattaaatcgggctgcaagtcaataatctgttgcatttcaggactaccactaatcttttccggttggaagacgggaatatcatgggcaaccgcgacttctttgactggcgaagctgttaagacgtgtttgcgaccaacttttcggtctggctgggtcacaacgcctagtacctggtattgttctttaattaaactttcgagaatcggtgccgcaaacgcgggcgttcccataaaaacgattgatgtcattgtcaaacttcctcctaatcccattacatgaaatgtaagggttccacgtcaattccaatctgtagcccttgtcgttgttgcgcctgcgtctcatgcagtagcgttgtcagcgtctgagctaaattgggttcttgtttatatttaatcacgatttgataataataacggcgattgactcgtgcgatcggcttgggcgttgggcctaatagaatcgttgacggtgccaaccgcgggcgtaaccattgcagtaactgatacatgcgcttggctgctaccccttcatctaagtcactcgctgtaatttgaaccgtaaagtagtacggcggataaccaccccggtgccgcatctgcatctcatacttgaaaaagccttcgtaatcgtggtgttgtgcaaaccgaatcgcataatgatccggattaaatgtctgaatatacacgtgaccactcttttccgcccgtccagctcgaccactcacctgggttaatagttggaaggtccgttcactggcgcgaaaatccggcaatcctagggccgtatcggcattcaagacaccgaccaaggtcacattaggaaaatccagtcccttcgcaatcatctgggtaccaatcaaaatatcagcttcaccactcccaaactgtgctaaaagcttggcatgggcgccctttttacgggtcgtatcattgtccatccgaataatgttagcgtccggaagcaagtcttgcaattcttcttcgactttttcagttcccgtcccataataacggatctgacgactatgacagttcggacaattccgcggaatggcttcttcgtgaccgcagtaatggcacttcatcgtgtgcgtatccatgtgtagcgtgagtgaaatatcacaattaggacacttcaagacaaaaccacaatctcggcacaacacaaacgatgaatagccccgccgattgagcattagaacactctgctcatgacgttcaagccgatcctgcaaggcaactaacagtggtgctgagaaattgctttcagcgtgttgttgcatttcctttttcatatcaataattgaaaccttaggaaggggccgtcgattgacccgatccgcaagcagtaagcgctgataaacgcccttttctgcgcgggcgcgcgtttctaacgatggggtcgccgaacccagtacgactggacagttatggtaacgactacgccataaagccacttgccgagcatgataacgcggggcatcatcctgcttatacgtgctctcatgttcttcatccatcacgattaagccaagattttttagcggggcaaacaccgctgagcgtgcgccaaccaccacctgagcctcacctcgttggattcgccgccactcatcatacttctcaccactggacaatccactgtgcaaaacggcaacagctttaccaaagcgccccttcacgcgttgaaccatttggggtgtcagtgaaatctccggcactaacatcaacgccgtttttccttgtgccaatgcggccgccatcgattgcaagtacacctcagtcttaccgctccccgtcacaccctctaacaagaacgtggtggttgcggcttggtcaacggcttgcgtaatctgatcgacggccacttgctgttcatcattcaattgtaacgccttggtagtcttaatatcactagttgcgtagggatcacgataaacctcgacggccacttttttaagccagcctttctgtactgctgtacgaatggcaccgtccgtgacatcaaaacgagtacaaaacaccttttgcgagagctgttcaccatttaaagtgagcaacccctggagcaccgccaattgttgtgtagccccggcgcgtacctggtccactgcagcctgtagcgcttcgttagttaaggccgctttcaccgccgtttgcgttttacgccgtgcttgatttttaacttggtagtacacatcgacttgcccagccgcctgcagccgtaataactggctgacgattgccggcgtcgtggcgacgtcatcaaacggcaccatcgattggtccccaaacagcgtcgttcgaatcgtcgcgggcgttgttgctgttgttcgcaactgtttttcatactttgcacgcatgaccgccggcagcatggtctgtgcacaggtaatctgaaatgaaaacgtgctggcagccaaccacttggtcagtgctaaggcttcagtattcagaaccggtgctaggtcaacgaccgcgtcgattggtttcagctcaccatcaaagttagtaacgtcatcaagagctaacacaaacccctgcacccgccgtttaccacggccgaacggcaccacgacgcgcatgccgggttgcacttgtgattgccaggcggttggaattcgataactataaggtcgatttgtctgcatagtgggcacatcgactaatacttgggcaatttgtgccacacaactcttcctctctacttaatcatgcctgtgttcctgcaccatccgcaattgccgtcatcaagatctgtttggcaattgcagttttcgttgtcaattccgtcgtaactggttgttgctcaggccgcaacagtgtgacctgattggtatcaccattgaacccaactcccggtttggaaacatcgttagcaacaattaaatctaattttttactagttaacttacgattggcattggccagcaatgattgagtttcagctgcaaagccaatcacatactgttggtgcttccgggccgctaacgtttttaaaatatccggtgtttctgtcaatcgtaacgttaagtcagcatggtcagctggctttttaatcttctgatcagctaattcagccggccgataatcagatacggccgccgccatgaccaagatatccgtatcatcaaaaatatcactgactgccgtcaataaggattgagccgaatcaaccgtcacgaccttaacaccactaggcgctgctaaatgagtcgtggcgctgatcagtgtcacagttgcacctaactcccgtgcgacttgagcaactgcgtagcccatcttccccgatgaacgattcgtgataaatcgtaccggatctaaggcttctcgggttccgccggcagtgacgacaactcgccgtcctgctaatggcaaatcaggtgtcaactgaatcagttgatctgtcaaccaggccaaaatcaccgctggttccggcaagcgtccttgaccactgtagccttccgccaacatacccgtagcaggagttaagacgtgtaacccatccgtcgtcagctgcttcaaattgcgctgagttgctggattagcgtacatatgtgaattcattgctggcaccacaaacttgggtgcggtcgtcgctaaaattgtcgtcgttgcggcatcatcggctagaccgttagccaccttagcaatcaagttggcggtagccggaacgagaatcatcacttcagtccagtcagctaacgcgacgtggacgacgtgatgcgggtcagtcgttgtgaattcatcaatgaccactggctgctgcgttaaagtttgaaaggtcaatggcgtgataaactttgccgcatgggtcgtcatcgcaactcgcacgacggcgccctgtttcatcaaactacgaatcaatactaacgctttataactcgcaatcccaccactaacgactaccgttacatggcgttttgtccatatactcacttcttcacgtcctttgaaaaatctcgcaaccgtgccagcgagatttttacactttaataaaacaattgtatcaagaatcgacagtaacgtgaagctgaacgtccgcgtcattcttcataaaaaaagtgccaagccccagctggctcagcacaccgttttgttactaatctttgtcagtttcatctggatcgatcattaagtcaccggccgcaatttcttccatggcccgaccaatcgttttaaccgatttgtattcgctaagcattggtgctgcaccagcgtccaattcatgggcccgcttgctagctaacataatcaatgagtaacgcgaattaacttgcttcagtaagtcatcaactgatggatataagatcatgattccgcatctcctaacatttcttcatactcgggcatgacccgtttaacactaaaccgttcactacgaataatagccttgattcgttcagcagctagcggaacttcatcattgataaccgcataatcataattacgcatcatcttgatttcatcaaccgcttttgccatccgcttgttgatcacactcatatcatcagtcccacgaccaatgatgcggtgcttcaattccatcaaatccggcggcgtcaagaaaatgaagacgccatcaggcattttttcgcggacttgcatggccccgttaacttcaatttctaagaaaacgtctttgccagccgccaacgactgcttaatatattttaagggcgtcccatagtaattgtcaacatacttggcatattcaagcataccgccgctcttaatttcatcctcgaactcttctttggacacaaaatagtagtccttgccatctacttcgcccggacgcatttgccgcgtcgtcatcgagactgaatattgaaaatcgttatcatctgagtcaaagatttccttgcggacggtacctttaccgacacccgaaggacctgataagacgattaacatgccttgtttcgccatgatcacaaattccccttaattaaaatatgttttaaagtttattttgcactttttaaccctatattgcaagtattatcaaggttacacagctttttttcatttttattcgtgaattttctcaaattttaggcttgctttttagaacgcctgttcgtataatggaaacacaaacaaatgttcgaggtggctaatatgcaaaatcaacaatctaatttgaaactaatttccaagaacttacacgcttcctatcgccaatttatggatgactttactgctgccccgaccgtcgttgcgccgttactgccaatgatgccggctttccagcgggatttgttcttagctcaagcgcacacggaacactatcaaatcatgctccagatgcagcctcagctcactgagtcccgaccatataatattcacggagtgttaaaaaacctcgctagtggtcagttggttctagttaatcggcagttacacctgacccacttggtcgacccggacgccatccgttatatcaaacgcgtttagtttaatcattaatacttgcatcaaaaggtgaaatcatgttcaatacaaccttgcgtattctcatggtgtttttgatgcaaatcaaaaagattgatgttacagctccactgacttccctgaatgagtgagtacggagtacctgtaaatcaatcttttttagtaacttaatttttatattacttcttttacttgtcgctcactgacgttatttttgagttggatcagcacgcttttcaatccaagccaagaccgtatcagcaatgattgccattaaagctgttggtaacgccccggccaagataatggcaccaccattcgtagcattggttcctcgaataatgatatcccctaaaccgccggcaccaacgaaggtcccaatggccgtaatcccgatagccaacactaatgcgttccggagtccagccataatgacggaaagtgacagtggcaactccaccattcgtaacagttgccaacgcgtcatccccatccccttaccggaatctaaaatactagcactcacattttgcattccagtataggtattcttgataatcggtagcaatgcgtataaaaagaccgtgacgattaccgtgttcacacctagtcccaaaccaatcatgatgattgataacatcgctagtgacggaatcgtttgaatcacattggcaatcgcgatcactgtcgcactcaaccgactatgatgggcaatgaaaatgccaattggaatcccaacaattgccgcaaacagcacgccataaattgaaatcaagaagtgacgtgagaactggcttaacacgtacacaccgttttgttggtaataatatatcaactgttgcagcaagttcatctgagccattatttgtcactcccttcaaagtaattatgtttttcaaggaactgtttagccacaacttccggttccactaagttattatcaacttgatagttcaagttttgcatcgtctttaagctgattttaccgtttaatcgattcaagattggcttcaacttcggatgagctttcaagatcttgttcgttgcaaccgcactcgcattgtatggtgggaagaaattcttatcatcctttaaaatcttcagatcataactaccaatccgaccatcagtcgagtatccgaggatggcatccattttacctgattccaaggcatcataaactaaaccaatttgcattggataagtcttcccaaattgaaagccatacaacttcttaaaggcaggataaccgtcaccttttcgttcagtccagatttgatccaaaccgaccgtcagcttcgaggctacttttttcatatcactaaccgtatttagatggtattttttagccgtcgctttcgtcaccataaaagcataggtatctgcgaacccataacttgggaaataggtcatttgatacttgctgttgaactgtgagcgaactttttggtcaatcgacttgatattactccgatccatcttttcgcccagaatcgtcgttaagtccgtcccagtgtaacgaatcgctgaaatatcagcctgatcattcttcaaggcattgaaactaaccgtcccagaacctaaattgttaatgatcgtcgtattcaaattagaataatgcttaatcatatcttgaatcatgtacgccatgatttgttgttcagtcgtgttttgtgacgcaatccggatcgtatcggatgaagttcctgacaaacccggaaagccacagccggccaataataacgcactggcgaccgttgcgaaaacacctaacaaccactttttaattttcttcatctttaatcccccttacgcttgtgtggttcttggggtaaccgctgcttctagtttacccaacagccaatcaacgatgagggctaagataatcaccggaattgaaccgcctaaaattaagtcagttcgatagaggtttaacccattaaagataaagtccccaaggccaccggcaccaatgtatgatgctaacgcggcccaggcaataacgtacgttgcggataatcgaataccagccataataactggggctgccatcggtaactcaactttaacaattgactgccaaccggtcattcccattcccttagccgcatcgatcaaggctggatcaacgtcttccagtccaagataggtattgcggagaatcggtaataaagaatagatgaacagcgcaatgatagctggaattgcaccaatcccgaaaaacgggatcatcaatgccaacaacgccatcgctgggatcgtttgtaacatactagcgattgacatgaccacattcgcaatcggcttcacccgcgtaagcagaattccaatcggaaccgctacgataatgcctaagaacaatgaaaacgccgaaatatacaagtgttgccacgtcttaaccagcagctgcatgccgtagttttgtaggaaagttatcatgcctgttcaccgccttcagcgggcgcatcgtcctccccatgatgaatattattttcagcttcatcttcgtcttcatcaccccagagagcatcataaacaatatcgaccagggtggcccgcgttacaattccgaccaggcgatgttgttcatctacgactggaatgttcttcaagccgcgtttcaaaatacgttcgaccgtatcccgaatcaatgaatttgactgaacatagaacaaatcagtcttcataatgtcgcccacactagtagccgagttaaagttgtaatcaacgtcttcaatgccgatcacacccttcaagatgccggcttcatcggtgactaacaacgagtcaacgcgtttatcatgcatttgtcgtaatgcgaccgtcaatgactttcctggtgtggtggcaattgggtctttcaacatcacttgcccaacagtggtaatacttggccgtgcttgaatcaaacgatccttaccaattaagttctcaacgaattcattagctggatgacgtaagataccgtctggcgtatccacttgcataatgtcgccaccatccatgattacgattcgggtcgctaattttaacgcctcatccatatcatgggttacaaagacgaacgtcttacctaagcgttcctgcaaatccttaacgagatcttgcaaagattcacgggtaatcgggtctaacgccccaaatggttcatccatcaatactaaatcttggtctgctgctaacgcccgaacaaccccgatccgttgttgttgcccaccggaaagctccgacgggtaccgatccaagtaatcttctggcaattccaccagcttgatcatcttcttagcacgttcattcattttatcttggggccactttagcaatcgtggtaccaaagtgatattgtctcgaatcgtcatatggggcattagcccaatgttttgaatcacataaccgatttgtcgccgtaatttaaccgggtcaatctggctaatatccttaccattaagtttaatggtaccggaagtctgacttaacatccgattaatcatccgcatcgtggtcgttttacctgaaccagacgtcccgatgaaacaaacaaattcacctttttcgatttccaaattaaaatcttcaacggctactttgccaccaggatacgttttattcaaatgttccattgtcagaaacaacctcatcactccaatcatttactcagtttatttcgttgccgaataaactgtactgtaattaagcataacttataacgaaagcaaaatgcaaacgtcatgacatgtaaactgaacattttatcgttttaacggtatattttggtagtcggagcttcagattagccacccactaccaaccagcccgacagttcattaaaacgtgtccgttgacccatatttcgtctatttgcgttttatattgtaaagaattatcgtcgccttggcaataataccgaaacctcactcgacaccatcgtcactaattaacaccatcaaaaaaggaccgaccatagttgtccgtcccttgtggtaccgatcaattaaacttaatcgtctttttcctcatcggccagtcgcaataactcttccgcatgctcaagcgataacttagtgaccttagttcccgccagcatgcgtgccaattcttgaacccgggccgcattatctagcttagtcacactcgttttcgtgcgcttaccagtaatcttcttggcaatgaagtagtggtgatcactcatcgccgcaacctgtggcaaatgggtaatacagagcacttgtgaaaagtgtgcaatgccgttgattttctcagcaatcgcttgagcgacccgaccgctaacacccgtatcaacttcgtcaaaaatgatactggtaattccctgtgattcagaaaaaatggttttcaaagccagcatcatccgtgagagttccccaccagacgcaattttggccaatggccgcatgcgctcgccaggattagtctgaatataaaattcaacactgtccagaccactccgatagatctgacccttagtcggtttgaatcgtacttcaaagattgccttatccatatacagatctttgagttcttgatggatctgtcgttgtaacactttcgccgcagcccgccgtttatcggacaacgcttcgcccgtcgtaagtagttgttgtttcaggtcggcgacccgctgggccagatcttcactattttcttcagagtcagtcatcttagctaactcagccgcgattttttggtaataatctaagatttgttgttcagagtccccatacttacgttttaactgggccaagatgtccagccgctgttcgatttcatccaagcgaccctcgtcgaattcttgcaaatcgagctgattagaaatctgaccggccgcatcctgcagcccataaaaggcattcttgacattcacggtaatctcattaaaggcggggtccaaattggcaatcggttctagtgcattcatcgccgtaccgaccatatcaaccgcaccagtcgtctcttcgcctgcagctaacaatgtgtaactctgttgaagcgcttgattgatcatttggtaattatccaagcggtcacgttccgcagtcaagctggcctcttcacccactttgacttgtgctgctgcgatttcgtccacttgaaagttcagcatatctaagcgttgagcccactctttttcattcgcattcttttgccgtaattcaaggtttaactgctgataacgatcatactgttgctggtaacgctgcttcaatttacgaattttagcggcggcaaactcgtccagcaatcccaggtgtttttcaggttgcatcaactcttgatgttcattctgaccatgaatatcaacaattgtttcaccaatctgtttcaaagtcgtcgtattgaccagcataccattgatgcgacatgtattacggccacttttagtaatctcgcgctgtagaatgacggtattatccgcatgttcgatccccgcttcgtccaacaattgggccgtcacgccgtcagccggcaaaataaacatgccttgcaaaacggctttatcagcaccggtccgaataaactctgccgagccgcggccacccgctaataaaccgactgcatcaataataattgacttaccagcaccggtctcaccagttaaaaccgtcatgccggcttcaaaagcaatgtctaagtgttcgataattgcaaagttcgtaattgataattcttgtaacactgcaagccctccttaaaagcaattggttaccagcatccgttagttaattttgaaaaaaagcgacctgacacacatgtgagcaggtcgaagatagcttactaattagtgatcactcagtaagcgttgaattttttgttgtagctctaaagtcatcgctaacgacttgcaaataatcagaacgtgagcatcatcgcctagcgttccaaaaatttcgtcataatgcattgcttcaatcaacgttgctagtgctggtccgttacccggcaacaccttgatgaggacaaatttatcctgagtcgcatacgagacataagcatctttcagtgtccgcttgagctttttctccgtatccatttgtttctgaactggcatactatagtggtaaccgcccgttgccgagggaaccttgaccagctgcatatctttaatatcgcgcgaaatggttgcctgtgtcacgtcaatatcttcagcacgtaacagcttgacaaagtcttcttgacgttcaatttcgttcgaactcaataatcgtttaatgtagcgttggcgctcttgcttcttcacccgatcacccccggtagctattcatacttatttaaacacatcataagccaaaatgcataaatatgaaagtccggatttcaattttaagcttgatttaattgttcataagcggccgcctgagttttttcaatcgacacagtcggcgcaatccgtggtgtttcatcggtagcttgtagatgaattagaaactcaatattaccttcaccacccttgattggtgaataatcaagccctagaacgttataaccattcgcttgcgcaaattccacgatatctgtcaacaccgcctgatgaacagcaggatcacggacaattccgtgtttgccgacattctcacgaccagcctcaaattgtggcttgattagggcaacgactgaaccaccgttttcaataatcgcgtgtaatgggggcaaaattaagtgtagtgaaataaatgaaacgtcgatggacgcaaagttaggttgcccctgcgtgaaatctgccagtttactataccgaaagttagtatgttccatcacaaccacgcgcggatcttggcgtaacttccagaccaactgattactaccgacatccaaggcgtaactcatttttgccccattttgtaaaaccacgtcggtaaaaccaccagtcgacgagccaatatctaggaccgttttgtcggtcacgtcaatttcaaaacttttgagtgctttttcaagtttgagaccgccacgtgaaacgtagggcatcggtttgcctttcaaatgtaattcagttgccactgggatcttcatgcccggcttatctaagcgttcttcgttgacacctaagatttcaccggccattacggcacgcttagccttttcgcgggtatcaaataatccttgttgtactaataatacgtcaactcgttctttttccatctaaatttaagtccttaatctgtaaaatacgttagaaaagctgcaagcaagcccatgcctcgttgactagcagcactagcttttactaacgccgtttgagcagctgttaccgcttgttctaacgctgttcgtgcgcctgcaagccccagcaaacctggatacgtattcttatgctcatcggcatccttatgcgtagcttttcctaactgagcaggcgtactcgtcacgtctaaaatatcatcgtaaatttgaaacgccaatccataggcatcagcatattgtaatagcaattcctgcacggctggttgcacttgagcttgaatcaaccctgcctggacagcgtagtgaattaacgcccccgtcttctcgcgatgcagctgttgtaaggctggcaaagccagatgttgtcccgctccaaggacatcagcaatttgaccagccaccatcccgcgaggtccggtggcctgcgctaatgctaaggtttgattagcgacgatcgatgccggtaacccactatccgcaatccattcgaaagtcaacggttgtaaagcatcccctgcaagaatggcaacgtcttccccaaacttaacatggttagtcggttcgccacgtcgtagctgatcattatccatcgccggtaaatcatcgtgaattagcgaataagtatgcatcaactcaacggccacacttgcccgcaagtttgcagccgtcgttgtgatatcaaaagtatctaaaatggctaacgtcaataacggccgtaaccgtttgccacctgctagtaccgaataacgcatggcgtcagtcagggttgattggtcagaacacgcttgaagctgctcatctaaatactgattaatctgaggacgccacttggattcaaattcagttaataattgcttattcattggcgtcagcttgctcaaatggaacttcgtcgccattttcattcatcatcttagtgagcgtcttttcagcaccttcaagggttgcttgcaactgcttgctaagtgccacgcccttttgaaattgatccaaggcttgttctaaaggaacatcaccctgctctaattggtttacgatcgtctctaattgtgataaattctgttcaaaagttggttgttcagccattattttcctccatcaatcttcgtaatctgtgcctgagcctcaccatcagccatgtgaattgcaaccgtttgttctggctgcaattgtttgaccccgtgaaccacctgttcatccgccgtcacaaaggcgtaaccacgcgtcatgattttaagcggactaagtagatccaacgattggacggtctgcgtcagttgttgccgtttttgccgcacgactaactgggtaccccgattcagccgttgctgcaagttaagcagttgcgtttgtgcctggcgaacttggtgaatcggcgtttgctgtcgtaattgttgaaaaacacgctggtagtgctggcttgccagattaaagttattttgaccagcctgtttaagtcgctcatttaagaagtctaacttctgcaaatacccttcgtacaagcggttcggctgagtaaacacgtacgacgtttgtaatttattaagtcgttgtcgatcgcgttgaacgaaattctgaaatgcattgaacacgcgggtctggtcttgctttaattgtaataaaacatcgttatatactggtaccgctaattcggcagccgcagttggggtggccgcccgcacatctgcgaccaagtcagcaattgtcgtatccgtttcatgccccacggatgaaataactggcagttgactctgtgcgattgcacgcgcaaccacttcttcgttgaatggccacagatcttcgattgaaccaccaccacgcccaataattaatgtatcaaaatcaccttgcgcattggcacgttcgatctgccgactaatttcggccgcagccgcatcaccttgaacttgagatggaaacaaaacgatctgcgcaatcggaaaacggcgccgagtagtcgtgataatatcgcgaatcactgcgccactgcgactagtgaccactgcaattcgccttggaaagcgcggaagcggctttttgggtgcactaaacaagccctcagccgctaatttctttttaagttgttcgtaggcttgatacaacgcacccacgccgtctggttccatgcgttccacataaatctggtaactaccactgggctcatacagaccaatccggcccacgaccagaaccttcataccttcttcaggctgaaatttgaccttggcaaacgccgacttgaacataatggctgaaatcttggcatggtcatctttcaaactgaaatattgatgcgtattaggccggggacgataattagaaacttcccccgttaggtacactttacctaaatatggatcaacctcgaatttacgttttaaatactgagttaaagctgtcactgtcaaatattgttgactttcactcacttacatcactccactttgcaagttccaccgttgtctgcatcaaggtggcaatcgtcattggacccacaccaccaggaacgggcgtaatcaaccctgcgatgccttgagcagaatcaaaatcgacgtcacccactagtttaccattttcatcacgatccatgccaacatcaatgaccgtcgcgcctggtttgatatcagcaccagtgatcaggtgtgcaatccccgttgcaaccaccaagatatccgccgtccgggcgaccgcctttaggtcagctgttttactatgtgcaatcgttacagttgcgttagcatttgttaacaaagcggccatcggcttaccaacaatggtactccgaccaataacaaccgccgttttaccagccggatcaaccccatagtcagccaacatcgtcataataccgcgaggcgtatttgctacaggataattacctggaaaattggtgatcaacttaccaacgttcgtcgggtgaaaaccatcgacgtcctttttaggatcaatggccatcgtgatcaatggttcattaatttgggctggtagtggcgactgcaccaagatgccatgaatgctgtcatccgcattgtatgccgcaataatggctaacagttcgtcctgactagtagtcgctggcaactgccgcaccacggagtgcatccccaacttagtggctttacgattcttatttcgaacatagatttgactggctgcatcgtccccaacaataattacagcaatccctggttgaattccctgagcagccaattccgctactgccgttgccgtctgcgcgttaactttcttagctactgccttaccatcaataatcttcgtcacaagtgccacactcctctttctctgtctggtcttattttagcatatcaccacaatgatttatgaccggtttactaataagttattaaaaaaagtctggcaaatcgccagacttttacggtagaacataagattgttcggttttagactaattggcttggtttttaaccactttaccaagcaccccgctaacgaatttccgagagcggtcatcactgaacgcctttgtcaattcaattgcttcattaaccgcgaccttagctggaacgtcgtcaacaaattgcaattcaaagaacgcgatgcgtaagataatcaaatcggtcttagccagtcggttcaacgaccacttctgacttaaataaggctgaatttgagcgtctaattcagcttgatgttcacgaacaccagttactaacgtacttaaatatgcgggaatttcaactgcatccgcttcttcagggttgagtaactgttggaacaactgattttcatcagcgtctgggttagcattcaacgcgaataaagcttgaaatgctttttcccggatttcatgacgcgttaaactcacgattcttcaccatcttcattttcatcggtctgggtatcttcatcaccaaacaagttgtttggatcaatggcactttcagtcttctcagtcacgataccagtgatgtggacattgacttcacttaaggcgaggtcggtcataaataagatttgttgcttgaccttatcttgaatcgctaaagcgacttttggtaccgaaacaccatagtccaagtatgcgaacacatcaacactaatctgatcatcgacgattgttaacttgacacccttaccaagattcttcttgcgaccgaacaactcatttacactggaagaaatcgtcccttgcatccggttaacgccatcaatttgacttaccgcgataccaacgattatttcaagcacttctggtgcaatttgaatttgtcctaagctgggttctttgctttgtaacgtaatattgctactgtcagccattttgacattcctccaattccatgtttgccggtattagtttttctaaaaattaagcccgtgaaacgtaagtggagtcaacggtgttaacaatcagcttgtcaccggccttaacgaagaatggtacctgaataattgcaccagtttccaacgtagctggcttggagccaccggaagcagtatcacccttaatccctggttcagtttcagcaacttccaaagtaaccgtgtttggcaaatcgattcccaacacttcacccttataaagcgttacttgaacttccatgttttccttcaagaacttcaattcgtcttgaatgtggtcgccaggaatttcaatttgttcataagtttccgtattcatgaagacatagctgtcaccatcggcataaaggtattgcatcgtactcttttcaattggcgcttgttccatccgcgcaccggcacggaaagtcttgtcttgaacggctcctgtccgtaagttcttaagctttgaacgaacaaacgcgccacccttaccaggcttaacgtgctggaattccacgatgcgccaaattgcgttgtctacttcaatcgtcaaaccatttttaaaatctgcagttgaaatcatttttaaaaatcctcctcaaatatatctttataactataacaagaccgagccgctgtggcaactgtcttaactataaaatcagtaaatcacgagttgcagtcgtcagtcgttcatggccctcagcagtcactaagacatcatcttcgatccgcattccgcctaaatctgggaaatataccccgggttcaacagtaatcacactgtttgcaactaaggtgccagtcgtgttttttgagatcaacgggccttcatgaatggcaagaccaatgccgtgacccataccatgattgaaggcgtcaccatagcccgcttttgtcagcaaatcgcggccaactgcatccagttgagcagtgcctgctcctgcttggacctgatcgatcacagcctgttgagcggcctgcaccgcctggtaggccgtaaccaacttatcatccggagtacctaaagcaaacgtccgtgtcatatctgacgtgtacccgtccaaaaagtaaccaaaatcaagagtaacaagttgcccggccgtcaagagcgctttagaagccgtcccatgcggcaaagccgctcgtgcaccaccaagtacgattgtcgtgaacgacggcccacttgcaccgtgcgtccgcataaacgcgtctaacaggttgctaacgtcgatttcacgcatgcctggtcgcacgatactcgttacgtattcgaaaccagcatccgccaaacgtgcactcgctcgtagccggtcaatctcatcaacactcttggtgatgcgcaactcatcgaccacgtctggtaacgcaaccaaatcactgaccaagttctcatctaagtaactgtaggctgtatatggaatctcggcctcgaagcccatgaccccagtaccggttttggcaataatatcacaaacggcccccagataatcacgtgtaatgactaggtgctggtcatcatagtgaccggcaaaagctgtctgataacgggcatccgtaatcagataggcttcctgtgccagtactagcagataaccatcgccggccatatcagccattcctgttaaatattgaagattagctccatctgaaactaagaacgcatcaatttttaactgatcaaacttattttgtaaccgttcaactcgactcattatttcgtcactcccatcattacctcacgcttcattataccaaactttccaaaaactgaaggtaatgatttattgaaggccattcgtcaatcaattacgtttacggctaagcggcccgtgaaccaataatagtcgcaggtatccctagattgcttcacaaaaaaagagcctccctgcagaggctcttcaaaaattattttgctgggtaaacagatacttggcgcttgtcgcgacctttgcgttcaaaacgaacgacaccgtcagccattgcaaataatgtatcgtcgccaccacggccaacgtttacacctgggtaaatatgggttccgcgttgacgataaagaatgttaccattcttaacagtttggccgtcagcccgcttagcgcctaaacgccgaccagctgaatcccgaccgttggcagttgaaccgccacctttatggtgagagaagaattgcaagttcattaacatagtaaagtccacctccgaatgtggttatcgtgtttgttcacgaactcggatgtaatctccgtaattcgtggccacatcgttcaaaccaagtgtgaaactttcaagtaaggtttgtaattgtgtgttcgccaagtccagcttagtgaaatctgcaattaatagcccaccattggtttcatcactttgtactacgggttgcaagcgggcaacttgttcaatcccattgattgtactaattgctaacaccgaaaccgctgcacaaacgatgtcttgtccataagcacctgaatcagcatgtcccgtcaacttaaaagcggtcacttgaccggtcgcattacgagaaatggttgcctgaatcataaagaatgcctactttcttaattatgcattaattgtgtcgatcgttaccttagtgtatggttggcgatgacccttcttagtatgttggcccttcttggccttgtacttgaaagtaaccactttacggtcacggccttgcttttcaacagtaccttcaaccgtcgcaccatcaacagtcggcgttccaaccttagttgtgtcaccaccaacaaagactacttgatcaaaagtaaccttgtcgccagcagcagcgtcaagtttttcaacgtaaattgcttggcctgcttcaactttatattgtttaccaccagttacaataattgcgtacacgtttgtgcacctccttaaattataaatcacttagactcgccgaatgtaagtgccattgctgaacttaagactcaatccgtgcggttgtagctgtagaagtccacaaatacaacaggaaaatattatcaaattttttcataatagtcaaggattgatttcacttcacaaaaaagtccgtgaaactaatgctccctaccgtcatcaaatggtgcatttttttaatacacttggttaagtaatgtggcgtgtagatcatatcattagctaaccaatcagtaatcaggccgactgtcgcagaaacgtaatacgcgatttgaatgctgaccggtacttccaaatcagcaaattgatcctgaaaatcacggtgaaatttcgtcatccacgtcgtcatctgctgattgatccgttgattgaccgctaactggcgctgatctaacaatagcgtctcaaaggcttccgcgtgctgactgatgtaaccgagtgcctttgataaggaaaaaacatgcacccgctgtaacgggtcagccggattggttataatatcacccactgaaaccgtcacgatggccgtttcaaacaattcacttaccaagtcatctagggcctgatcaacaaatgctggcttgtctttatagtggagataaaatgttccgcgggtaactgctgccgtactagtcagtttttgcacggaaatgttatcgactgtttctgtctgtaatagtgtaattaatgcttgtcgcaagcgccgccgagttttatcgacacgcggatcaacttcatgactcatatctgctccctactttcatttcataattaatataacattaattgctaagagcgtctaacagatgataatcagccggacaaatagttagattacgtctaagatggttctcagtgatctatctggcccattcattcgactgacacatgattgatatggggctcacctatctgccactatcatactagctggttagtccttacatgccttagcatcaattcaaagctaaattgatctttaggaacgctgtaaaggattttatcttgacaaccgaccaaaataaccgttatactaataatgcaatttttgggaaaagtctggcttttcctgttaattcggttgcaatgtacactattcttgtttaatatagtcgttattggactaatcaaaggagggacatactcttatgactgttgttgcaaaaccatataacacatgggcatcacgtcggccagttgctgggaagcaaaagcgcattcgtcgcgaaaaagaagttgctgctatccaacgttgggctgccggcaagactgacaccatcgaaaaaacaccaaaaatcaagtaattaaaaaagaactgctcatcttgaatgagcagttcttttttaattgattgattgtataatgccaatgtgcaagataagaactcccgttgactaacggtcattacgggaagcagtgaaatgcttactgcttgcattttctttggcaacaaagtttgaataatattgaatgccaccagcgatggcgatgataccgacgattgcaaatactgaacccataagaattctccttccttgttacatgattattatcgttttgttacagtaacatttcaagcgaaataaactattttagtcagttttgttagtttctttatcttttcttaagtattttaggagatattggttcttcgccgtcgccatttaacaaccccgccttgcaaagattaaattaatgatgaccggacttagttaccgctattacagcgtttatattgtgtcgttcttcaagcattaattggtattcatgaaaacaatttcctcgttcaccaggctaacttcatttttgactttcaccataatgaccaattatctcagcaaaatgtgcttactgtaatttagtgctttttcattacaaatattacattttcaatttctgtttacatataactgtactaatgcctaaagatattacgcgagaataactgcgcgttaataataacctgcatttttctatagacaacaaaaaaatccctgtgaacagggattttttgtgtcaagcctatttcaaatatgtcacgagtgagacttgaactcacaaccctccgcttagaaggcggatgctctatccagttgagctaccgtgacaacaacaagactaattatagataagaagctgaagcgtgtcaatttattatttaaaattcgcacaatcaatcgctattcagattcgtttaggcgcctggtaaataacccgacataatttgatgtccatcattaaacaggtaataattgaataagttactgaaaggagattcccaccgatgaaacagaaagcctactttgtcagttggcatctatttgtactgctgacaaattattatatcaaccagtcttatttccaattgccatggtatctcaactcaactatcagcagcttggtcacgctaattgtcgcatccgacttgccgattaaacacatcaagcataccagtcagcgcaagcatctgcacatgctcaatcattggaccctgctcccactcttaatggccgagttgatcattaattttgactttttgaccatttccagctttgaaatggttagtttactctttaaattgatgagctggttgctagctatattcatcactcatatcaccagccattattttaattatgagtgcattatttaattccccataaattgcgcaccaacctgaacttcgtgttcattcaaccaatttacaatcaagacaccgtccaatccaccacaaccttggtgtagtacaatcaacgtatctaatactgtctgggggaatcaacaatgcttttacgccatggcttaaccagtaacatttatctgaacgattacttaacgtttattcagcaagggcgtgacacctttgaatttcatcataacttattagtcgcacagcaccattaccacctagtcatcaacgcccaccatgcctttaacgctttctacgctgaacagaagcggctggccgagcagctgatggactaaatcaattctcgcatcccatcctaatagtgcgtataatatgttttgaggtgaaacatattgaaacttgaagcaattgccggaaatatcgcgcatgccatcaaagatcgttcaactgacgggccctacgtactcgcggtcgagtttacggacaaagccaccaagggaaagtcagccactggttgtgtcatcgtccggatgccagatcaccagcactatacgatcaccagcaatgactttcggtatatggatgcggacaaagatactttagctgaggaactcggggccttctttgaatgcgacgatgatcttgatcaacgacaaacattgatcgaccaagttaatgacttagttgcacaagacgccgataatgacgcgcaattaatgacagccgcttaaaaaataacctagttacgtgatcaaatcgcgcaattaggttatttttttaatagttatttgcttgtcgttgctcattgacatgatttttggccgtaaacgccgtttgtatctcgtcctgagtaaaaccaaaatcaactagcccaatcttcaagaaaacgtgccaagcgtgctggtagctctcctgacgatggttaaagtaagcatcatagaggaggtgcttgatcgccaagtactgtttattcaaatcagtcgccggcttagccgcaatcgtagtcaattgctcaggcgttactggaatcaaatgcgtccactgttgaatcgctgagacaaggaataagaagtccatcgcatctacgtattcgttcagcagcgtttcgcggtgtgtcttatcaggatccgctttgccacgatgaatcttccaaactttgaaccattccgacgtattagccatttctgccaattcgacgtccagtgagaccatcgcattttgcaaccgttcttgtggccgccaatgaatctgttgacgggccgtaatatcgcggtctaaacgaatcgactgttgtaataacgttgttagttctaacatctaatacccccgttacttaagcaaatactaatggatccgcttttatttctagcgaatcgatattttctaagtaccaatcacgcatgaacccaaagtgtaacaacacgtcaaaccacgaaactgcttgatcaggatcatgaacagtcaggacccattgttgactaccgccagcttcagctgcatcaaagatatcaactgtcaaaccagcccgcagttcaatttgggcaccatgtccttgctgtgaattacgcaacatgtgctcattcttagccgcactgacaaacaatttgtcaacgattgcccgatctaaattagccgaccgcagttcatatttagccgcgttagcaacgtccaaaatattaaagtcgacgttaaagccaaaatcatcttgtaagcaatgtccaaatttaattagcgttgcgagaaccgtattaatttggtcaaccccagttcccttcaacaataatttattaataaataaattcgtaaacgccgaactattaaaccgtaacaagcgccgttctaaatgaatataaaacaagttttcgccagttgtttgttcacgataatatgcaccaccgttgccgttgttcaccacttgatacaagaaggtgtaatcatccgttagcgccccgtaaacgtgatacagcgcttcagtatgccgttgagaattcagcaccgcttgttcatcaccatgcatgcccaataaccgactcatgaagatcaaataataatcggcattctgatattgatggggaaacgtcacgtaagccgtatccagtttaaagtctgctagctgttgtgccgctgctaacagtgtctctccgtcagttgtatcaatcagttggtccatcaaggccgtaaatttttcaccattagcgagtcctttttttaagccctcattgaacgtactcagcttaccgtgagtgctcagtgttgccgtgtccatctgcttgtccgtattattcgccatcagccgctacctgcgccttcccaatcagcgtggtcaagtagtcaacataaagactacggttacgctcattaaaattctcaaaactcttaaaggcgttttcaatcgcttgtttctcataagctaaaatcgtatcttccttagaaagcgttaaaatcttagcttcgttatccttcatggttgcatgggcattattagcttgttcgtcttcatcggccaacttagttaactggtcaataatttgctgccgttcttctttgatccgaccagaatcaaatagtgagttacgttgcccattttcctttagttgctgccgcaattcttctttttgcgcatcacggtctgattgcgcgtcaatcagtttctgtagctgatcgctaccagctgagatctgctgaatacgatctgtattgaaacgtttgtgcgcgggagccagttcaaacgtcttttgtaatttattgtattcttccgaactaaattcaaaggcgactttcaaaacgttcaatttaccaaaccggcgccgatcccaccagttaccaaagtaaatctgaaattcgccgagttgggtttcttcataataaaagaatgggtactcatgagccaaataatcaattaacttggtactcaagtagtgactgattgccggatagacatccgtaattaaatccacttgggcgttacgggttggatccggttcctcgttaagtaaggcttggtgatagtggtcaccatcgatcaattcgtagatcaaccggtcgtcaccagccgtaattgcttggcgcaccgtagttacatagtctaacttttgttgaagtcgcttcgtaagcgcgcgcgtaggttgatcttgtttttcaagatcaggctgattttgtttttccataataatctccttgcaatcaataataattgaaaacttgctgaattgcattgctgttcctaatgttaccgaaaattagtgcattaataaaggttaacaccactaatttaccaattttataacaaaaacggctagttcgccatttaaggtgccctaaccgtcgtatttttatctcaattaatggtttagtacaattccatgtactgatcacgttcccattcactaacttgttgacggtatgaagcccattcaagccgtttagcttccaagaaactctgataaatatgtggccctaacgccttcttcatcgtcggatctgtctggaactctttcagcgcattgtgtaacgttgacggtaagtcagcgataccagctgcagcccgttcatcttcatccataacatagatattacgatcaacactctttggtggttcaataccgttcttgattccgtccaagccagcttcaagaaccgctgcaaaggccaaatatgggttagttgaagcgtccacactccgtaattcaaggcgcgttgacaagccccgtgcacttggaatccgaatcattggtgaccggttagatgctgaccaggccacgtaaacgggcgcttcatatccaggaaccaagcgtttgtatgagttgactgtcgggttagtgacagcagtgtatgaccgggcatgcttcatcaagccacctaagaagtgataagcgtctgatgataattctaagccattcttatcattagcatcataaaaggcattgccttgatcatggaacaaggacatgttcacatgcatcccagaaccattgacaccgtttaacggcttaggcataaaggttgcccacaaattgtatttccgtgcgatggtcttaacgaccaatttgaacgtttggatatgatcggctgcagataaagcatccgcgtacttaaagtcaatttcatgttgaccaggtgcaacttcatgatgactggcttcaacgttaaaaccaagtcgttcaagttcaagtgcaatgtcccggcggcaattttcacccaagtccattggtgataagtcgaagtaacttcccttatcattcaattcggtcgttggttcacccttttcattcatcttgaataagaagaattcaggctcagtcccacagttaaatgacgtataacctgcttcgcgcatatcgttcaagacacgaattaagttgttccgtggatccccttcgaacggcttacggtcagacgtgtaaacttcacagataatccgtgcaattttaccatgttccgtgttccaaggcatgatcaaccaagttgataagtcaggatacaggtacatgtcactttcttcgatccgaacaaacccatcgatggatgaaccgtcaaacatcaacttgttatccaagagtttgtcgagttgtgaaactggaacttcaacgttcttaattgtgccgaatagatcagtaaacattaaccgtaaaaaattaacgttttcttctttgacgatgcggcggatatcgtcttttgagtaggactgttttgccatgaaaatcgctccttaaattgattgactaacgaatgcaaacatcttagtgtgccggataattggggcccttgtcggactgcaagcctccgagattcaggaattcatcatgaaggattcggcgcacatcgcgatcagttagcggcttagccaagtcagcttgcttctgctcagctcgctgtttctggagcgcatatatttctttgattccagccatattgatgccatctgctaagtaatccttgatttcaagcaaacgatcaacatcattcaacgaaaacattcgccgattaccggcatttcgttccggcgtaatcaattcttgctcttcatagtagcgaatttgtcgcgcagacaaattggtcagcttcataaccgtaccaattggcaagacggccaacgagcgacggagttccttttccttcataacgaccctcctctttaatacagacttaatattagcaatgttatcatcgaatgtcaatcattcatgttagaaaatatcacacgttttatcataggtataccaatttataatttagcttaaccaactagctagccgttggtcaatcgaggcccgtaattcagggtgttccaatagattgatccagtcgaccgacatcttgttacggaaccaagtcaactgacgcttcgcataacgacgtgagtcctgtttgatcttagcaattgattcgtcacgcgtctgctccccattaaagtaagggaaccattcgtgatacccgatccccttaccagccggtaacatggcgccaccttggtcaaatagccaccgcgcctcttgttccaatccggccgctaccatttgatcgacacgttgattgatccgagtatacagcagcgctcgctccgcggtcagacataaggtataagcatccagtgtgtcaccgtgcgtatccgcctgctcagaaaaaagctgaccagttgtatgcacgtactccaacgcccgtacgacccgtaccaagttagcgggcgcaattgcggtggccgcctgcggatcacgctgtttcaacgccatccacgccacatccgaaccttcgacagcggcacgatcaaaccaagcttgacgatacgccatatcaggttcattatccgctggtccaaactgatagcccgccaacaaggactgcaagtaaaagccagttccacccacaataataggcagtttaccccgagcactaatatcaatgatcaacgccgtcgtccgactgacaaattcagcgactgtaaaacgctgatcaatatttttgatatcgattagatggtggggaatgcccgcctgctcttccggcattattttagccgtaccaatatccaagtgacgatagacctgcattgagtctcctgaaatgatttcaccattcagctgtttagccagcgctagcgataatgccgtcttaccgactgctgttggtcccgcgattagcaatactttatgtttagttactgttgtcactcgtttaacctccttgtacctgcttacgaattcttcgtgctaatccagggtagtcggtaatcagtcccgcaaaccgatgacgataacagaaccgcatatcgcgttccgtgttgaccgtccatggccgcaactgcacttttggcaataagagccagtgaactcgcacccaacgaatatccggatgataaccgagaacaatgtgttgcgcatgaagccgcttcgcagtttgaaccttagtcttgaacaggctatccgattcgacctcgggctgtaaaatatgcaaccgttcgatcgactttccgtagaagctcgaataaattagcgtaaacggaacttgatgatggttaaaataatccgctaccaagtcttcgatcccctcataatgaatcttattagttttgatttccagattaaaaataccagtaaagttgtattgaatcaataattgaaccacttcatctaaagtcggaatacgcgttcccgcataggctgatgcatacttaacaccagcgtccaattgctttaactcggccaacgtgtgatccacaatccgacccgttccgttagtcgtgcggtcgacgagctcatcatgcataataatcagttgcccgtctcgcgacaagtgtacgtcagtctcaatgccatccgcaccatcctcgatagccgcaataaacgctggtaacgtattttccggcctggtccccttgctaccacgatgagcaataatttgagtaagcattgcgtttcaccccacttttttaaaaattagattgaattgattgctatctccgcataaaacaagcataataaaactaacaattgctaggaggttttactaatgaaatcatttacccgtggcttcttgtttggggtcgtcgcaactgctggtgccgtaattggctccgtcttatcatttaagaagcaagttgttgatccaatcgaagaccaagaaaacaaattcgaagaaaaccggaaaaaggcgatgcgcaagagccgctcagctcacaacggttaattaaataaaaaatggtggccgaacaagttgttgttctagccgccattttttaatacttcgcttttttcgtcttaccttcccaacgtgcgtaaccgggttttaaaatgtatagctgtgaataaccattcttagctaatgtgacgacggcccgtgtacttaacgtatgggtttgatcgtaaacgtagattggcatatccttgcgaagttcgttcatccgaactttcaaactgttgaacggaatattccgagcccccagaatatgaccagcgtcaaactctttcttttcacgcaaatcaatcacttgcgccttacgcattcccgcctgaaacgcttcttcgtccaacatcgtggacacctgacgccgtcgaatgtaactatacaactcataaataaagtaggccgcgattatgataactaacacgatgttaacatacgccatgccgctcaatgcacctaaaaccacgttatccctcctaatttctacttatctattttacacaaaaccgcttacttttactaggggtaagcaggaaaagccgcgattaaactgctgactaatcctgaagtcccactgattgctttatggccgtactcacccacagtttaaaggcatccattaaaacggtcgggggcctgagacccgcatttaaccatgctgttaattcaaaaccaagcatcgcggtatcacatttatgaatccgaatcgatcatcttaatctgactaccatgcaccagtaatccctgattgttagtcaaccgtttgaccgtaacgcccgtcttatgttcccagtcggtgatcaactgcggcaattgcggctttacttcacaatgaacatcataatgcggataaatacggatcgtcgtcgcattgatggctgttgtgcttgccagttgctcggtgttgtcctccgggtataaataggcgtacaggtctaaatccgggcctaacaagatggccccggcgctaataccgtagattggcttgcccgccagcgcgagagtcctcagtcgttccagcacgtgcgtttcacgcagattcttcaacagtaaaaactcgtagccaccattcaaaataatgaccgttgccgtattcaatgcggccaaatcatccgtcaatacatctaggagctgcacgtgcgcatatccaagctgctgaaccgtttgttgtagtgccaccatttgggggtgatttttacccgtgctgaccgaattgacaataatcacaattctcgcactgttcttagccaccggcgccactaaagtgaaaaaggcgtccgttacggccacagtgctaaacgcccgtgaagacaataataactttaccatcctgcttctccaatcaattctgtcatctaattcaattcacgctagtcgatccgtatcccttgcgccaaatcgcgtaacagttcatacgccgttacaacaacataccgacatgaaactaaaatcgcgcatagtctgaggacatgagcccaaatcagcatcggcaattggcgctcagtttttaaccacaacctaatcagcacagtttttggagcttagtataaaaaagaagctcggacattacttccaagcttcttgacgattgattttaacttaaataaaccgttgggccaatgaacctgctccgataacaccagcgtcgttacctaagaccgctaacttcaaagcagtcgtgtcgcgaatcgttgggaatgtgaattggttaaagtaactgatgacttgatctaataagaaatcaccagcagctgaaaccccaccaccgataatgattgaagatgggttcatcgtgttcccgacattagctaatgccaagcctaagtaataagaaacccgatcaacaacgcgtttagccaagacatcgccttctttagctaaatcgaaagtgatctttgaactaatttcttcaccgttgtctaataattgtttcaacttagaagcaccagagaattcttctgccatatcgcgagcaacgtgaacgacaccagttgcagaagcgtattgttccaaacaacctttcttaccacaagtacacatgtagccgtttggttcaaccgttacgtgaccaatttcaccggcaccaccggcaataccatggagtaaacggccatcggcgatgatcccaccgccaacaccagttccaagcgttacaaagacaacgtcactaccgttttcgccagcgcccttccaacgttcgccaagtgcagcaacgttagcgtcgttatccagcgtaaatttgatgccagttcccttttcgatttgagccttaactggttgtaaggtcttccagtttaagttgtaggcaccgataaccgtaccattatccaaatcaacggtcccgggagtccccattccaattccgataaattgagaacggtccatcttatataactcaatgtggtggttgatggaatcgatgatgttaggcacaatgtgggccccttcatctaaaatcgtggtttcaatactccacttttgttgaatatcaccattttctgttaaaatggcaaacttagttgtcgtcccaccaaggtcgactccgattaacttacgctccatgttgctaaatccctccattagtcatgcgccgcgtcttcacgggcgcgttctgcttctatccggtgctcatggctcaatacgagcttgacgcgggcatacatcttcgggtcaatgacaccagcttgatagagatgatcgatctcaatggccattaactcaatatcccaaattcgcttgcctacgtacacgtacacgccaaattttttaagtaattgttggacgtcgtaaagtgttttcatgtgcatatcctcgattaattatacagttaaattagcatttgtaaaacccatttttaataaagctaaccagccaatgactagaataaccgttgccacaattcgtttcagcggcgcaatcttgccaattcgtggtacacccagcagatagcctaacaaaaagccaccaactagacccccgacatgtccccagatatcaatgccattcgagaacatatcgaatactaaattcaaaacggttagtagtaaaaattggttcgtgagctggcgaatcactggattttcccagaacgattccccaatcgtcaaaaaggcaccaaagagtgcgaaacacgccgtactggcccctactgactgattattggataacgcgaaactcataatgttaccactaatgccacccaaaatataaattgccagcatccgccaatgaccatacattgcttcaatttgcatgcccataaaataaataacgacaccattcagtgcaatatgggtaagtcccatatgtaaaaacatcggcgtcaccaatcgccaccactggccggccgcaattgcttgattgttcttagcacctagtgaattaaaaaccagcatggcgccgtcgcccatcagccactcgactaagaagactgccacagtaattccaagtagcacctgcgtgatagccggttcagtttgccaccagcgtttaattctcatcatgttgttcatcccctgctaccaagagttcgtctaacaagacgtcatattgatcaaccggccattcagcgtgttcaaaagccatctcgtcataagccagtgtcaacttcttacccggataatcagcgaggtaacgatcgtagtagccaccaccaaatccaatccgggcgtgccggtcacggctgtacccaagaccaggaactaagatcagatcgatctgttgcttggcgactggttcacccgtgacgggctctgggattccaaaagacgttcgctcaagtcgatcagtcgcttggtaaggataaaaagccatttgacgatgcggcagcgtttttggaataaccaccattttgccctccgcccaagcttgttcaataagtgggcgcgtcgctacttcgatgtcactactaattgtcatggcaatgacctgggcagtttgccatgttgggcttgcaaataattgagtctgtaacgcctggttttgccgttgccggtcagccggcgtcatttggcttaatcgcccaagctgttgcttacgaaatgcttttttctccacgtacggcacccccgaaaataaaattggtataaaaaaatctcattcattaacatgtcaaattgaaaaatcaatttggcagttgccaacaaatgagaaacccattgtctgatgacaatgttacagaaaaaacaacaggagtccccgttgttattttgtttcacgatgtaatgtcactttgtgttcccgtggacaatacttcttaaattcaacccggtccggattgttccggcggttctttgaagataagtagttgcgttcatggcattctgtacattcaagtgtaatgtgtacccgcatgttgttgaccctccaaactcattcgcatattacagggccggaacccttaacttgaactactataccattaatgattaaaaaataccagtatcaattaagatactggcacgaaaaaagctgattttttacttgttataatacttccagaacgctgcataaatttgcttagcaacgaccatattataatcaccactagtagcagtaattcctggaaaggcaaccgctatcactactttagggttcttataaggcgcataagtcaccaaacttaacgtttcagtagatgtcgttccgtggaatgtctcggcagtcccggacttagctgcaaccgctggtgataaactagctagtgcactccccgtccgctgcgtcatactcccatggaccacatcccaatacccttggtgtacgacatcaaagtatgaggatgggacgtcaatggtattcaggacacgtggcttaacattagtcttaacagccccttgggacccgttagatttagtcccagtaatagcggaaacgatgtgtggtgcaatgcgttgcccaccatttgccattgtcgcaatgtattgcgccagctgaatagtcgtgtaagcatcgtagttcccgtaggacaagtctaacgctttaccaatatccttctgtgccgaagaaccttggtaacctgaggcttcacccggcaagtcgatcccggtcttaacacctaagccaaactcgttaaaataaccacgaagtttagagaagaccgaattagacatcgtcaaggctttcccagacgcatagctgaagttaccttccttcatggctaattgcatcatataggagttagaagaaacttccatggcagtcgaagcgttaagactcagactagttccaccattcttgttaaaccatgacgacttggtggccgttccggctaacttgatcggcgtatcggtcaaagtactattcgtgggtgtaatcacaccatcttgcaaggcacccatgaccgtagcacccttaacgaccgaccccataacgaaggattggttgatggttcccaacgcattttcagtcactttaccagtggatagattccggctggcacctgctaatgcataaatggcaccagtgctagggttcattacaacagcataggctcctggcgagtaggcattgctactccccaccgttttggcttcagacataatgatactttgaacctttttctggaacttcgaattaatcgtcagctgaacgttgtcacccttctggccaccgtacttcttaatctccttttgaatgaccccatcctgcgtcttgacctcagtctgtgacttggttccacgaaggacattttcgtactgcttttccaattggctctgaccaaccgaatcatcacgagaatagccttctgccagcaaggttttaatgctatcactcggtagcccttgcttttcggtcgtaactgtcccgagcacactactcaagtcagtcccattaggataactccgagtccaactcgttccgaccttaactcctggcatttcggattggtgctcaccgatttcagcaagctccgtactcgtcacaccagtcgatttgatattgaccgttgacagcgagtacgccgaactcatcttataataaatcgccgccgcattcttttgcgtagacgttaaattattaatgatatgtttttccgcataggcgacttcccgtgcgtacaaaacatcatcgtcgctagacgttttaaccttcttagcaaccgactttaaattagccgcccccgctaagtaataatcagccaagttccgatccgttaatgtatccgttggaatggttaagtactcacctaacttattcgccacttcgtacatcttagtcgacgcaactgacagccccttcgtgtattgaatcgcttggtgggatttgtttcccactaagacccgaccggttgaatcataaatcgatccccgttgaacgtttcccgttgccgtcgtattattggctgaattcactgtacttcggaacttctgtccgtagtcaacttgtaagtaagctaactgcgcaatcaacgcagcaaataacaagaaaacgatgaaaaacaagaagttcagccgaaatggaatatgcgacttgttgggatcacgatttatcgtaattttcttaaacaatttcaattctcaggcgctcccattcttaatttggtaaacatttcgcaaaaatttaccagatgatactagcaatcctagataaataccatacttatgttattctaaacgatagacataaaaatttcagccgttattacggattttaatgtttttttgattatttttctgtttggctgtgaattattagagattgaggtggcaatttttgaaactccgtcgtttttttgacaagcgcacatggccattatggatcagcttttggttacctttactgatcatgaccggttattttatttatcggcacatggctccctttggatcaagcagtctgttaacggtcgatttaggccaacaatacgttgacttgttttcctatttccggcataccctactgcacgatccgagtgctttcttctattccttctccaaaacgattggtggcgagatggttggggtctgggcttattacttaatgagtccctttaatttaatctacttactattccctggtcaatcaatcactaccggcatttttatcgtcactgtactaaagtatggtttcgcagggctatccttcgcctggctactaactaaaacgcagacgcaaaagggttggttggtgccaactttcagtaccgcatacgcactgatgggctggatggtcgccaatcagctcaacatgatctggttagacacggtcgccattttaccattggtcattttgggactggaacgcttgtttacaactggtaaagtccgttacttcgctggctggctggccgtcatgctaattgacaactattatatgggctacatggtcattttattcagttgtttatactggttgtatggcgcaactaagtattggcaaaacgtgaagaccttagcaactcacgccctcaaatttgcttggggtggtctgctaggtgtcgcattctccgcatggttgctattaccaactttctgggcgctcattcaaagtaaggctcaatataatgtgaccaaggttcattggaaacttgaatacgcgccctggaaaatgttagctaagttcgtcaccggtactttcaacttcgatcagatgccatccggtcaaccgaacttttacgtggcatggttagcagttctcgcctttgtgctcttcttcttacggcgccagttcaaatggtccgtgaagttgagcgccttgattgtaaccgcgacgcttatcttatcattttgttacgaaccacttgatttattgtggcatgcgggccaatttccagtttggtacccttaccgcttctcctttgtcttttgtttctgggtcgtctggattggtgcccaagcactgacagacaaaataacgatcaaactgtggcaagcgctaacgatgctcgcattgctggtcggtttgtttacaaccatttacttgaacattaagaaagtcacctacgtcacccaagctaatctcttaattacaattggcttggcagcaattacattgattttcttaacgttgcctaaggaacgacgtctcatttatcaaatcgtcgcgttaattttagttgcgactgatatgtcgatcaacgtggtcgcttcattaaataatatttcctacgtgtcacaaagtgagtttggtaaatacacgcaagtccttgacaatgccgtcaacaaaattaaagctagcaacaatcgtttttatcgaattggtaagacgtttatacgaactaaagacgatccgatgcaggcggcctataacggtgctgatcatttcagttcgaccttcgaaagtattatccctaactttttcggttcaattggtcagccggatggggacggtgtggtcgcctacaccaacgggaccatgattaccgattcgttactggacatgcagtactttatggataaaacagtaccgacatcccagactgataacgcgaactatcgtagctacattccggtcaccagtaccaagaaagatctgacgaattaccaaaaatcggcaaagctcagcactaacaaagtcacgacctacaaaaatccatacgccctgggtcttggtttcgcagcgtctgacaagattactagcttgaaagtctccaaaacaactggcgatccgattgcccggcaagagttgatttaccaaaccttagcaaatcgttcaaccagcggcttgatcagtgccgaaaactttaacgaagtggtcttccaaaacgttaagaaggtcacgacgttaactggcgccgtcttgaacaaacaaaatttagcgaaaacggggtcggtttactttaagttcacgccgacaaccaatgattcctactacatcacactcgggcaaaatctaactacttcgaatgcgagttactacattaacggtaaggaactcaagcagtacccaacttaccggcacacgatcgctgttaacgttgcatcaaatagcaagggcaagaccgtgaccttcgggattcagatgaagaagacttctctctggttacaaaacttcaccctctacaagttggataatacccaattcaagaagtcggcgcagaaactccagcaatccccttggaacattacggcccactcaagtcgtaagattactggtacaatcaacatcaagcatcgtcaccaagttttgatgacgaccattccttactccaagggttggcatgccactgttgatggaaaatccgtcgcaactaagaaagtgattaatacctttgttgctgtcccattaagtaagggcaagcatacggtcaccttgacgtatcgaccgccattcttaatcactggtagtctgattactgggattagtgccctcgcaacggctggttggtttatcgtccggcgtcgacgccaccacgcctagcccggttcacagtcaaagatgtggtcagcaaaaatcagcgttacctgaattgttaattcaggtaacgctgattttttgtccaaatattaatcgctattggcaagcactcaccagaactactcgttattgggcgtgtagtcatacttcgggccgtcattttgttcatcataatcaactgtgagatcatagcccttaaagaaccattcatcacggtcgttgacatagtaattgacaccatccttttcaaccatggcaatcggttgatggggttcgtcatcacgcatgatcccgattgagaagccactgtgaactgctgtcttgccataagttttgccgtaaaagcgcaccccattaccagtggttacacccatgtcatcatgaaaccacttactggccaaatctgtaattgttattttcattactaacacctcatcattgaaatcgtttacagtaattgtgccctttttgcccataaaacgcaacattgacagtcgatgagcaagccaatgaccagttgcgttcctgaaatgaccgctaagggagtctttatttacagcgtcattgttttgtggtgtacttaaactacttaaggaggtgaaacccatgcaagtgaacattgaaacggagcccgacacctcaattccaaccgtcacactgcatgttccagtcgactaccccgaaacggccgccctcactgctgctctcaaaaatctttcaattgaggccgctacgttaaccgtttcacaacgtggtcaactcgtacagttaccgcttacttcgatcctattcatcgaagcaactggtcaccaggtcgccgcccatacgctggataatgtttatcgtgttcccaagtcgctgaccgctgtgggcacaggcttacctgcttactttcttcgcgtctccaaatctgccattgtcaataccaaacaagtctattccttaaccaagacattgaccgggaacttgattgcgtttcaccactcacctaaacaactgtacgcttcaagacgctactatcgccaactcaaaataagtcttgaacagaaaggactgttataaatgcataaaaattggttttggcccgtcttcttaattgccagcgccgttgttcttatcgttagtcaactcggtctcttcacgctccacgtcagcatctggagtctcttgttaacattgattctagttgcggctttaattagtagccttcgttacttgaatatgccgggcgtcgtcttcgctatcgcattcttaaccatgatctatgcgcaaccacttggaatcactaagctcgtaccatggacaattttaggggctgccgtattactcagcattggtttgggtcttttgattcatccccgttatcaatatcattatcgctatcacaaccatgatcatgctcattacaatcatcataaccacgatgacgtccatgaatcaacgagcacaatcaacgatgaccatgttaatttagatctctcactaggcaacagtatccgctacgttcacagcgaaaattttcgttctgcggatctgaacgtatcaatggctggtgccaaaatctacttcgatgacgctgacatcaaagaaggccgagcaaccatcaatgtcgacgtttcattaggtagccttgagttatacctccctcaaacttggcagctacaggaaaatctcagcaactcaatgggccacatctcatcgacaggtacaccgaccactgctggcccgggtgtcatactaaccggcagcgtctcgcttggtgaattacgaattatctatatctaaccctactttgctgtcggccatatcctgatcaatctgtcataaatcatgattaaaacatgccagttggttggattactgttcatcagcacttgcgcgtcatattccgacctccggggctgggtgccaattgctggaacgcagccgacgtcgatttgagctaacgcataacccgcgtcatctcaaatacgagtcttattctaagccggaagcaacccacttccagctaagaataatttggctactgagcattgtcacccagcccctccggtctcaagcctgtgaggggtcacgggttgaagccgagcattgcctagccatcggattaatgcggttttggcattagtccgttggcgtagcacgcacaggcttcagtggtaccgagcacatttcggaaacccgctcgaatggctgataaacggccacttaacttggtgcaattggtcgtcgactattttaatactggaaccttaagtacaatatcactctcagtctgacagttgattgacaaaattaccgtttttgaaaagcaatggccaatttatcaaaagttgggtacctcaccgtctgccattcgaatactatcccgactggaaggcgtttctgacaatgcccagtggtgaaatttcacttagcaagcgtcctttgcttggttagtgaaaggccagtatttgagacgtggtgtttcggctcaaatctgtgcccaccacgttccggcaattggcagaaatgcctggaggtcggcgtaggacgaacccacaacaaaagtctacgcgagttcgagctgtttccagcgggtctaagctggctgttttcgaacctacacaactggcatgttttaatcatagtaaatgctaaaaaaatgtaacacgtccaatttactcacccgtttacctgctttgtgcagataagcgggtgttttgcttgaattccgaactcacacgcaaacgtgcttgttcagtaacgttcgttaaatagtggctggtaatcagtaatcgcgcttctaaaccaccaaaaaagactgtttcaaggtatccgctacctcaaaacagtcttaagcataaaattacgcgttttcaaccttcaaaattttaaccgtcatggtaccggctggaatgttgatggcaacttcttcatcaacgtgatgcccaatcaagcccttggcgatcggggaatcattagaaatcttgccaaccattggatcagcttcggcagcaccaacaatggtgtagctttctggttcttcatcaggtaattctttgaacgtcacgattttaccaacggagacttccgtttcgtcaatcttgtcactatcgatgatttcagcatattgaagcatgtgttcaaccgtcttaatccggttttctagcaagctttgttcattctttgctgattcatactcagagttttctgataaatcaccgtagctacgtgcgatcttaatacgattaataatttctggacgttgattaattcgaaggtcttcaagctctttttccagcttgaccttgccttcttctgtcattggatatgtcttatcttcagccaatgtgtttcactcctcaaatacgcaatatagttatcaaaaaccagcctaccatttcagattttaaaagtaaactcttaaatctaaaatagcgctggttaagacgttattttttataaaattgaacgaactttagttgtcaataaatcaatggcaacttcattttcgccaccttctggcacaattagatcggcataacgtttcgttggttccacaaactgatgatacattggtttgaccgtcgccaaatattgaccaatcacagagtctagtgtccggccccgctctttgatatcacgctgaatgcgccgaatgattcgaatatcatcgtcggtatcgacgaacaccttaatatccatcaggtcgcgtaaacgctgatcatctaggatcaataccccttcgacaatgatcacatcacgcggttcttgatgaatggtcttgtcgctacgcgtatactgctcgtaatcatagaccggcttttcaattggttgataggccagcaactgcttgatttgcttaatcatcaaatctgtatcgaaagccagtgggtggtcgtaattaacggcatggcgctcagccattgtcatttcactttgatcattgtaataggaatcctgttgtaagatcaacaatgattgaccagataattggttgtaaattgcattgctgaccgtagttttaccactaccggaaccaccagttaccccgatgactactggtcggcgatgtttattttcagtcatttaagttacgcctcattcttatttttcagcggcttcgttgtgcttcgaaaccttcttgatgtttgccgcgtgacccgcagcatcctttgcataatagacatcaccagtcttcaaatctgctacgaaatacatgtaacccttgctccgttgtgcaggatctaagactgccttgatcgatgttaaactaggactgttgaacggtccggggccgtagcctaagttcaaccgtaagttatacggtgaatcagtctgcaaatctttattcgttaacgttgacttgttagaattgatcgcatagaacactgaaatatcagaatccaagcgccacttagcatctaaccgattcaagaagacgccagcaatcaaccgccgatctttcgtcgtactgccttcacgttcaactaaggacgctaaggtcattacttcttgcacggacatcttcgacttcttaatttgcgcgtagtatggttcaagctcatcattagtcttcgaaaccatctgcgttactaattgtttcaaagttgttttcttaccaacaacataagttgccgggaacaaatagccttctaaacgatagcgaacttgcttagcactcatcgctgaattcaacaattgtggatacttcttggccaatgatttgatgaatgtttgatccttcattaaggctagaaattctgccgacgtgaaatcagtttgtttttgaaccgtcttcgcaatcgtcttaatctgactaccttcaacgattaggactttaccactagaactctgaaccggttccgatgaaccacctttattcaaggccttcgcgatttgagcaagtgacatcgaaggcttcaactgatagtagcccgcgtgaaagtttgataagttgtgtgctttcgtccagtattcaaagacaaaaccactcttgatcaccttttcgcgctgtaaaatatcggcaattttcttaccattagcaccgtacgggatatcaacttgaacgacgcgattgtcgctactgtcatatggttgcgtcgcattatcaaaatatcgataacccaatacccccacaataattaaaagtacgactaaaataccaacaacgccaccaataacgtgtttcgaaaatgatttccgctgtttttgttctgaacgattaggttcatttaccccacgatcttgtgaatcgttttgatccttctgatcttggttatcctggttgttattcaagactcgcccctccatttattgattaatcttatcaattatacaaaactgttgcccagtttgcactagttcgccattagttttatggttttttaggatcttggacacacattaaacgccgaatgacttcaaatcattcggcgtttaacaagactatcaacaaactaacgaatttcagcacctaattcatccgttaaggctgtcagtactttttcaaatgctgtcgtaacatcatcatcgactaacgttgcgttttggtcttgatacgttaacgtataagctagcgactttttacccgctggcacgtgactcccattataaacatcaaagagttgaacgtgccgtaaatgcgcgccgcccttcttgttgatcaaggcaaccacggttgcgttggtcacatcgtcatcaatcaacatcgccacgtcccgggtgatacttgggaacttggaaattggttgatactgttgacgcgcttttggtaaggcaatcaacgccgttaaatccagttcaaagacataagtttcccgaatcttgtaggctttggcagtcgttggatgaacttcaccgacgaaaccgactaactggtcaccaacgtaaatatcagctgtccgaccaggatgcatctctggatgttcggccgtggcaacgtaactaacggcatcttgcaacgccagactcttcagataaccagccacgatacccttaatctggaagaaatcaacgggttgttcggcaacgccccagctcttgggaaccatggaacccgtaatagctccggcaatgtgttcaatttccttcggccggacttgttcaggttgactgtaaaagacccgtccttcttcatacaatgccacattgtgttccttacgagcattgttataagctaaatcatccagcaaaccagaaactagactcaagcgtagcgtggtccgttctgaactcattggaaagtctaatttagtgacgtcactagcatgaagcgcaaaggccttcgacttagtctccgtggtcaatgagtaactgatggcttgcgtgaggccagcactttccattaacttacgtgagtcacgaatcacctgttggatctcattaagcttaccgattgttggttggcccgttggtagggtcgctggtaagttatcataaccgtatagccgggcgatttcttcgataaggtcagccggaatatggatatcccaacgccgtgatggcaccgtaaccgtgaacgtttcattagcaacgaccgttggaaagtccaatcgtttaaaaatatcactgaccgtgtccaatgacaactcagttcctaagacgtggttgatccgtgctaagtcaatggttactgtcgttggttgcacatcctcgtcacgaccgatgaccataccactagcaacttgaccatcaccaagttctgcaatcatggctgcggcagcgtctaaggccgttgcggtcatgccgtggtcaatgccccgttcgtagcgcattgaagcttcgctgtgtaagtcatgattatgggcagttttacgaatcttaactgcatcaaaaaccgcaccttccaacgcaatggtcgtagtctgatcagtgacttcggtcgctaggccacccatcgtcccagccaaacaaattggttgatcgccactacaaatcaacagatcactcgttagtaattcgcgatcttcaccatctaacgtcgttaaatgctcgccagctttcgccaaccggacgttaatttgaccgtcattcaattgatcaaagtcaaaagcatgtagcggttgtccatattgcatcaaaatgtagttcgttgcgtcaacgacgttattgattggccgcataccagcattccaaattcgaatttggagccataacggacttggcttaatcgtaacgtttttaattagacgcattttgtacattgggacatcatgttcgtcggcagcgacagccacatgtagatcatccgcagccaccgtcgtagcatcttcatgcaaatcaactttcggcatcgttggttgttggtcgtaaatggcagcaagttcatgcgccgtaccattcatactaagcatgtcaccacggttaggggtaacggacatgtcaataatttcatcatccatccctaggtatgaaaagaccggatcacctggcgtggcatcgtcaggcagaatgaaaataccatccgcaacttcttttggaactaacttttcatcaaaaccaagttcgtctaaggcgcacagcatcccatttgatggaactccccgcatcttactcttcttgatcttagtgtgaccaccaatccatgaattgggtaacgccacgatcaccttttcgccagccgcaacgttaggtgccccacaaacgatttgcaagggttctgattcgcctacgtccacttgacaaacgtggagatgatcagaatctggatgtggctcacacgttaagacgtgccccactacaacttttttcaatccttcactgggacgaataacaccgtcaacttcaacggccgtccgttcaatcttttctgctaattcatcggccggaatgtccagcttcaaataatcgcgtaaccatgtcgtagaaattctcatgtggacgcctaacctttcttatagaactgtgacaagaaccgcacgtcattcaagtagaagttgcggatatcgtcaacaccgtatttcaacattgcaaagcggtctggtcctaacccaaaggcaaaaccaccatattcttctggatcaatgccagacatttctaacacgtgggggtgaaccatgccggcacccagtacttcgatccaacccgtttgcttacagattgcacagcccttgccattgcaattaaagcaagttacatcagcttctacggatggttccgtgaatggaaagaagcttggccgtagccgaacatcgaattgatcgccaaacaaagtcttggcaaccagaattaaggtgcccttcaaatcagccatcgtaatatgcttgtccacgactaacccttcaatttgatgaaattgatgggaatgggttgcatcatccgtatcacgccgataaacgcggccaggtgacaagaccttcagcggtcctttagaaaaatcgtgattttcaagtgaccgcggctgatcagcagacgtctgcgtgcgtagtagcacgtctttggtaatatagaacgtgtcttgcatgtcacgggcgggatggtccttcggtaagttcaaccgttcaaagttgtagtaatcttcttcaacttcatcaccatcaacaatttgatagcccattcccataaatagatcttccaattcagtaataatctgggtaatcacgtgaggctgaccttgtggaacttcccgacccggtaacgtcacgtccagtttttcggcagccaattgctcattaacggctgcttgttccagttcttcacggcgttcatcaatcgcagcctgaatccggtcacgaacttcgttggcataagcgcccacctttggccgttcttccgggcttaagtcgcgcattccgcgcaatacttctgtaatcggaccctttttgccaagtaaatcaactttgacttggttaacctttttcaaaacatcggcggatttaatatcggccaagccttgatcgcgtaattcggttaatcgatcttgtaaactcatatgctgcctccaatttttagttgcgttgcggacaaaaaaagaccccatccctgaaaagggacgaggtcatcgcggtaccacccttgtttgcatagcagtcactatgcacactcactacccgtcataacggtcgggataccggaaaattatttgtttacacaaacgcccaatttcagctcagagagtgaattcgtcaatcttggtcgccagggtgctttcaatcggtgacacccgtccctacgacgccgtaactaactactatttctcgtcaaggcttttatctacattgtcagtttatggcaaagtgccctgcacgtcaaccccgtattaggattcggccgggctgaaccacttatcagaccagttatggaccgtatccatgacctgtcgtaaatcttgccccttcgtagtcaagcgatactcaatcagggcagagtcacaatgggttacccgactcacaatgccgttttcttccaattccttgagacgaacgaccagcacccgatcactgcacttaggaatccggcgtgccagattcttaaagcgttggggaccgtcttccagtaaaacatcgataattaaaccgttccactttttccctagaattgagaacgtcttttcaaattttggacacagttcgaaatccacgttggattctgttaccgtgtcagctagcatttctgacatgcaatgacccccaattattgaattaaccggcggagaccttgcctcggaaccgatctagttgtttggccactttcatacgtaatggtccaaaaaattcatgttctgcttcataatcatcaactaaagagacgagcaaactttcacgatatttaggcacagctaaagttgcaccaaacatatgcttcaaaatgatatctttttccatcggcgttaatttcgttaacttttcagcgttacgtaacgctacccgcggatgaataaatgcgtgcgagccgagatcaaacttggtttcacgccagtcataataaaacaaatcatgcaataatccaccacgcgccactgccgtcgtatttagatgccatttcttcgctaaaacataactatcatatgaaactgcaatcgaatgatccaatcgatttgaatggtggtgctgtgtaaactcagcaagccgctgaacggccggctgtgctaataaatcttcgacgatcgccacgtattcagaatcttgttgccacgcattattagttttcatctaaagctccctttgctaatatctacggctattctactaaaaagccagtcattttgaaagtattttacctggattttagcattttcttactaattgtaagttagcgatataaaccgaacattaaaacgccagcagccacggctacatttaacgattctgcttgccccttgatgggaatgtataagttttggtctgtccgtgccaataattcccgactcattccattaccttcgtttcccatgatcaagccaaaactagccggcgcgtcaatatctaaataccgggctgcctgtggatttaactctgaaccgtagactggtgaaccctgcgcctgcaattggtcaaccaacttgtcgagatcagtactaatcagttgtaaatgaaactgactcccctgcatagctcgttcaactttgggttgatggatgtccaccgtcccggtaccgaaagcgacgccggcaaaacccgcagcatccgcagtccgtaccatggttccaatatttccgggatcttgaacattatcgagcagtaaccaaggccgcgttaaatctaattgtgatagatcttcaattgcagcaggcagggtcgccagcgcaaacaccccctgcggcgtcaccgtcgcactgatatgtttggcgacttcatcagagatttcaatgaccgctggaaaatgagtcaaatccggttcggtcgccagttgcttggcagtaatgagcaaggtctgaatcgcgacgtgtgctttaactgcttcgttgactaaatgccaaccatctagcaagtattgtccctgttgtttgcgtcccttctttgtttggagctttttccacgccttgacgtgcgcattttgtaatgaattaattttttccatcgtcaacttcctttaattaatcggttgaaacatcagccggtcttgtcaattcggggcaccctgtatcattcgaaagtgtccgttttatcccaagtatagcatatcgcccgttgaacatttccatgctattatataagtaatacagattgtactaattatgctaacacaatacaatcaagatgctagtcacaggttagactagctgaacaagttaagtaaggaagtgacacaatgcgtgcagtaacattaaaagcaatcggccgggtccagggggtgggcttccgttgggccactaaagttgccgctgacaaatgcggcgtgaacggaatcgttcgtaacctgatggacggctcagtctttattgaagccgagggtgaagatcaacgagtgcaagtctttatcgacgttgttcggcagtcgccaaccgattttggcaaggtcaagcacctcgaagtgcatgaagttgaaccacaaaactatcacgattttcggataaccaattgaattcccccgacatctttagtatcatcatcattatatgactttaacaaaggggattattaactagtgaaatcaaaaaaaggccttacgctcaccatcaccttaggaacgttagcactgtttctaagcggttgtgtgcaaacgaccaaagctggtaaaccatacgggtttgtttacgagtaccttgcaaagccagggcaaaacgtgatggaatggttgtcacaactattcggtaacaactacggttgggcaatcatcggcttgacggtcattgtgcgactcgttttactgccaatgatgattaatcaacaacgtaaatcaacctaccaacaagaaaaaatgtccgcggttcggccacagatggaaaaaatccaggcacggcaaaaagcagcgacgactcaggaagaaaaagccgcaatcagtaatgagctcatgcaactttaccgtgacaacggtattagcatgactggtggtattggctgtttaccactactgattcaactgccaattttctccgccttgtactacgctattcgctattcgcctgaattatctaaggcgacctttatggggatctcccttgggaaatccagtctgattctagccattttagcctttttatcctacttggcacagggttacctatccatgattggtttacctgaagaacagaagaagacgatgcgtctcatgctcattatgagtccggtcatgattttatttgtttccatgtccgctcccgcaggtttaggactttacttcttcgttggtggtttgtttgcctgcttgcaaacactgatcatcaacttcttccggccacgtattcggcgtgaagttgaagcagaactcaaaaagcaccccatcaaaacaccaacaccgacgcaaccaaagccgattaatgcaactgaatccaagcctagtcatcctcgtccgcaaaataatgcggggcgtggtcggaatgccggtaaacaacaacgacaccgtaaataaccactgaagcttaatcaacactaaagcaccgtcatgaaaattctcatggcggtgctttttacgttgcacctaaccggcacacagccgtcaccttaactgattttgcaaacattaccacgggatgccaattaacgctgccaggcccgatcagattaatttcttacttaaccggtaggaataacccacggtcaaaatcacgaccaacacgataatcgtaacaaaggcattgagaaatgagtctgttgacatctttcccatcgctactaacagcggtcctgagattccaaataatctgcctgctagcacgttagtccgatgccagttttcttctgacaaataggtccacggaatccggattccaaccaagcgattacgagaagtatatgccatcggtaatgcgacaatcgagatgattatcgcaatcagcgcaaagccaagcgtggaaatccggttgaaatcaataagtaacaaataaaataaaacggtcaagttaatatcagcaccgagatacgttcccttgcgccagttgggattctgtttacagatcaaaattaaactaatcccaattaaaaataacccaccaaccacggccaacggtgcattacgaactcgccacacgggcgcaccactggccagtttgatcactgctaagatgaccaaattgattaaatttaccatgataaacaatttaaccccaagcgtctgttgccatttttctggaatcatgagtaagcccccattttaaactgctaacccaatgagattgcagcaccataattattctaataccgagtccgacgttatgcgtgatgcgtgactaaaacacgcaatcgctgagagcaaggatgaccagcaaatcactcacccgtatgttgcaatcaataattgctcaactagttaagcgcaattatagctgaattgcataataaggggtagaacttgcccactttcaagtttgtccgccaacattccaaactaaatcaaacgtatttcgtcaaaattaatctactttgggcagacgacacttcgagacctgaaattttatgtaaatatgcgataatggaaattaacaattcaaactcaaggaggaactcccatgaagttactacatacagcggattggcacatcggccggacgcttaacggttattctttgttagatgaacaggaagcagcgttcaagcaaattctaacgattgcattggctgaaaaagttgatggtatcgtgattgctggggacatctacgaccgggccgttccgagtaccgatgcggtcacttcactcgaccacatgctgcaggctattaatatcgagcatcacctaccaatctatgccattgctggcaaccatgatggcgccaaacgtctcaactacggtcgtgaatggctagcctataataattttcatatcaatacgttactagccgaggccttcacgcccatcgagaccccaacggcacaaatctttatgttaccgttttttgaccccattgacgcgcgggtctactatcagcaacaaggtttgcccgaaaaacaagtcaaggcgattcacaccattcacgatgcgatgcaacgcgtggttagtgacctcgttaccacctttgatcctgaaaaacggcacttgttgattactcattttaccgttacacccaaagcagatgacgacttggaattaacaagtgaaacaacttccaaagtgggcggtttggcgacgctgaccaccgatttattcgcagacttcgactacgtgatgctgggccatattcacactcggttagcctcacccgacaaagatcgaattcgttatgccggtagccccgtcaaatttaacgtcaaggaagccaaccctaagttccatggcaaaggtgttgaaattgtgacaatcacacccactgcgatcacccatgaattcaagccaattcagccgcaaactgacttggttacgttgcgtgcgccttgggaaacgttacttgatcccaacttttatcagcaacagccgttaaagcaggcttggtttgcgatcaccgtccaggaattcgaccgtagtaagcatctgaacgtccgggcgcaactcgaacaaatctacggcacaattgtcgaactggactacgaatcgaaccaccaagccaccgccattagtggcccaaaaaacatgaacgaactgagtcctgatgccattgttgggcaatttttccacgcgattactggtaaccagctctcaacgacacaacaacaactcgttgaccagattttcgtcaacttaagaaaagaggattagccgtgaaacccgtttatttagccatgaactattttggcccccacgaacattcaattattgattttagcaagctagaaagtaccccgatttttctgattagtggtgatactggggccggtaaatcaactattttcgatgccatgacttttgccctctttggcagtacgacgaatgatgggacggatggtcgggcagccaaagagatgcgcagtcagttcgcccccgctgaccaaccgacaagcgtcaccttctactttgagcaaggcaatcaactctataagattgcgcgctcccctgaacaatacttagctaagaaaaaaggatctggactgacgaaaaagaatagtacggccaaattagctgtcgttgatcacgttggtggcgtggagattgagagcattgcaaccaagccggccgacgttggtcccgagatcacgaccatcttgaatttgactgctgatcaatttaaaaaaatcattctactcccccaaaatgacttctcggaattcttaaagtcaaaaacgactgacaaggaaaaaatccttaaaaagatttttggaacgcaactttattcagactttactgcggaacttaaagcggagtatcaaaccgccagcaagactggtgatcagtttgtcgccgatttgcgggtcgcactagcctcagcaacttggaatgatgcggaacaggctcaacttcaagcagttccggacgatcaaaaaattccactactacgagcatttgttacgacgcgtcaaagtgtttttgaccaagcacagcaaacgactagtaaaatcaatcggtctgttaaagcggccgaaacgacctaccagcaagcacgcgatcgccaacaacaatttgaccggctcacacaggcgcaagctgattatcaaactaaagttgaagaacaaacaccggcaattaccatagccaagcaacagttgcacgcgttaacttgggcccagcccctacaagccaccatgcaagccctcactcaacaaacacgtgaccaaaagcaattgacacttgaccagcaagcagctatggataacgtgcaacaagcgcaggacgactatcgccaagcgcaagctgcagttcaacaattacatgaccaaagtgaagctaaccatcagcaccagcagcgcttggaacaattggccacgttgattccacaagcgcaacgcgttgaaagtctcatcgcacagctcgcaaagctcaagccgagtgtcgctgatctgaaggcgacttttgaacagcaccaaaccgtaataaagacattaacagccaaaatcaccacccaacaagcgaacttgccatctattgatgacttacacgccactaaagatttgctgattaaacaacgagaacagttcgtcgacaccctgacaccacttgatagtcaatggcgaggtgcgcaacaagaacagcagcgcgtcaccaagcaactgactgatttacgggcgcagcttgcccgcgatgaacagaatcagcacaatgcgcaagtccaatttgaacaacaacgtggtcaacgccaaagcttaatgattgcccaattacaacaagaactcgttgacggccagccctgcgtggtctgtggatcaaccgatcattcacagatgccgttcacaaccatcgttgcaaatgaagctgacttacgacaatccatgcaagccgttgacgacgctcaaaacgcgctggcggcagccaacaagcaagtggaagcaactcaacaacgtgtcgaacaggctgaaaaagaagttgaccaggctacgcagcaagtaaccaccgcccaaacgcaactaacttcaacttaccaacagttgattgaaaccaacggactagcactaaagtcaccctacgatttgaccgcagtcagggcttttttcgctgagcaactcgccacaattacgaagaagcttgaggcagcccaacgagtggttcaagctattgagaaatatactgctgaactggaagcacaacaaaaacaggcccaacaaacggagttacagttaggcgaacaacgggccttattgcgcaataaaacagccgatttgacggtagctcaggcagccattggtacggacttacaagtcacaagcgctgacctgctggccgaaaaagcgcatctcaatcagatcgtcgcgacctaccaacaacgcctagaggccgcccaagccaccgttcaaaccagtcaacttactttatcaaaacatcaaactaagctcgatgatttaaacgaccggttgaagacaacacaggccacgcgcacgcagcttgagcaaacaatcgcacaggccttagctgctccagaagcaccgactcatgaccaaactgtacttgaaaattggttagaagaactcgccaatggtcgactgaccgccctgcaagtccaaattgccacctatcggcaagacaaggagcgtctgacaaccgaaatcaagcaactgcaaaccgccttaacgaacgttgaacgaccgaatattacgggtatccaagctcagctggccgacctgcaagctcataaggatcgggcactgcaatcccaaaccgtggcggaacaagccttaaccgacgcgcaaagttgtctcgaaaaagtccaacaaatcatgcaccagcaaggcacatttgcaaagcggttcgccgaaattacaagcctgtataatatcatgactggtaaagatggcaacgatcacaagctcaagttagagacctacgttgtccaaaactacttgcaacgcgtcttaaactacgccaatgatcactttatcaacctgctttccaataaccgctacacatttgaactagctgccgaagcgagtgataaccgcagtgaccacggcctcgatatcaatgtttacgataatgaaaccggcaactcgcgttcatccaacacgttgtccggtggtgaaaccttcattgctgctctgtcgattgcactctcgctcagtgaggtcgttcaatcttcggctaatggcgtccaaatcgacgcactgtttgtcgacgaaggcttcggctctctggatgatgaaactttggaaaaagcgatgcaggcactcgaaacaattggtgaaaaccgaatggtcggtgttatcagtcacattgaatcaatgaaacgaacgattggccaacaagttctcatcaaaaagatggggggtggccgcagtaccgtgcggttgatcagtaaatagccgccgaaaacaaccgcagtacatgactaacaaggtctaaaaaacagcgacacaaaaaatggcggccgtcattcagcaattatgctggatgacggccgccgtttttgtgaaccatcccaattaatcagaccggattaaaagaaaatacccaggatcagtccaagtaattgcatgccttgaaacatcatcaaattttgtggtgccgtattaaaggtggtttctttcacttgcaccgcgttaaaggcccgaatattcttcaaaatttttggtaaaacgagcaacactgccagctgataaatcggtagtatttgtaaaacaacactcatcagcactggcaaataacctaacagcgctagcgtatcgtagacccgtagtgaccaacgatgaccaatatagtacggaaccgtataacgttcattgcgaatatcctgttgtaaatctgaaatattatcagctaacatgatattcgcaaccaagaaaatccctggtagccccactaaaatcatgaccaatatgttctctaagttccccacaatcgcaaactgcggccaagcaaacttaaagcccgccagtacgggggtcgcgacgttcatataaacactcagaaagaaaacgccaaatccttcgacacatcctgacagtaattcacccaacgggaagcgcgaaaacggcaccgggccataggtatagaagatagccacaccaatcgctgcagcgcccatgaacagtaacaataggtttgttctgacgactagcactaatcctaaaataattgcagttgctaacatcgctagcatcaaattcaatgatcgtcgtggtgataggtgctcacggccaacaatgttataagtatcccgataatgtaaatccttagccaagtagtaatcctgcacgttattaaaccccgtcacaaacaatgcaatcgctacttgtgcaactaagtaaattaacgaattgatccaattaaacgcatgaaaataatagattgaaaataaaataccaataaaatacggcaccacactagctgccttggcatttagccgaatgaattccaaaaaaattttgaacgtcattggccgataagttggttcgttcgtcaacaacttcgccccctgattaaattaactactcttccactataccaaaaaaggttacttgtgaaaatggtttcatgatgaacataccaacaaatatcggtcagcttaaatatatttcgagtcggatcaatctgaatcaggattaaacccagcctgctggtgtacaacctattcgtcgtttaatcagcatcttactgcgccctatcgaactgtcagtcgatgctcaatattgatccaggcctccctcaaaatcacgatatgatcccataggccgcggctttaaaattcattacagcgcaattatccatactgaaaacgcacattcaagttaaattaacttgaatgtgcgttttaaattcataaatgactcgattacctagtggtcgtgctcatgatcatccaagggcgcttcatcttcatcacgagtagctggtcggattccggctggcagttccgacttggcaatcttttcaacatcattcgtttcagcctcggccttagctaagagcttcgcgtcccgtagaatcggtaactggaaccgaaagatcgagccctggcccaccacagattcaacactaatatgaccatggtaaccttcaactaaccgttgcgcaatggataatcctaacccgttaccacccttatcacggctacgcgccttatcaacccgatagaaacggttgaaaacccgatcgagattgtccttagaaataccctcaccaaagtcttggacggcgacttcaatgtagcgataatccgtggataatgataaatggatttctttacgtcgtgtcgagtacttgaccgcattatccaataaaataatcagaatttgctcgaggtgattacggtaaatctgagcatacaccggctttttaacatcatcatcaaacgtaaaatgaaagtcgggatgaatcatcgtaaaatcgttaaatgcttgcgtcactaacttctgaacgtccgacgtctcatggctaaaattgatttccaattgttcagcacgcgataagtccaacatttcttgaactaagctctgcattcgcttggtttctgacaaactagccgccaatgattccgacaacacttgtggatcatccttgccccatcgattcagcaactccatatggccctggataattgccaccggggtccgtaattcatgggaaacgtcttcaacaaattgctgctgttgattaatatagcgttgcatctgatcaagcatatcattgaatacaactgctaaatccgacaattcatcattgcgtttaagatcgggcactcgcgagtcagtttgcggatcatcattgaccgcattaatcgtctgtttgattttacgcattggccgtaatagaaacgcagctaagaagtagcccagtagcgtggcaccaaaaatagtgatcattgtcattacaataaagatccagatcaaattctgagtcgttgaatggtattccgccaaattatcagtgacctgggtgtaaccgatcaaacggtgattgctagccgcataaatgggcgcccgcccaactaattcagcatcacttcctcggccaatcaacaccacctgacgcgtcttattcttagagaactcatgtgcatccttgcgggatagatagagtgtgttcccgtgtggatcataaaccgtcacagctaagtttgtgcgggataaggctgttaaatcggaatctgaaaagattttactttgcagcacaccatgcttacgttcactcatggtagttgccggttcaacgctcgcctcgggttgcaatttagcggccaccgacttaatggtcagccctttcgactccgttcgcaacgattgttgcaccgttgtaacagcactagccacgttccgttgttcttggtgcaataagaggttcgtgaaactcttatagaccaataatgaaaaacaaataaaaatgagcgcggacccaattgcggtcccgagcgcccatttccattttaatgaccaacggcgccgtggtttaggcgtcacttgattcgtatcagcgtcagtcattaagaacgaatcacgtatccagtcccacgaacagtttggatgtaactcttttctcctggtcggtcaatcttgttccgtaagtaacgaatataaacgtcgacgacattcgtttcaacttctgattcgtaaccccatactttgtttagtaagacatcacgagcgaggacaacgttaatattttccattaaagttaataacagttcatattcacgcttcgtcaagttgatgacttcgtcgccacgtttaacgactaagttttccttttcaatcgtcaagtctttataagtgacggtcgtttgtttagtgctttgttgttcactttccaaatcgattcgccgcaatagtgctcgtaagcgggcaagtaattcttcgatagcaaatggcttaacaatgtaatcatctgccccatgatccaggccggaaactcgatcaatcacggagtcacgggccgtcatcataatgatcggcgtgttcttgacttcacgaacccgccggcagacttccaaaccgttcagttctggtaacatcaggtctaataggatggcatcaaaatcttcagctaacgctgcgtctaaccctttacggccgttatattcgacttgaatatcatagccttcgtgttttaattctaattcaacgaagcgtgcgaggtttttttcatcctcaataattaatattcgactcatttacttttattcactcctaatattcaacttatctaaaaaccgtacgaatcagtgatttatcaccactaacctgcattaagctagtacaacatgttattttaacatgaaaacgctgaatttcctacaccccaaccagggtctgctcctcacccaaatctaattttagtgaattctcattaaattgcaatctttatgtctcatcatctgacggttcggtttgcggatgttgctggtgccactggcgaatagcagctaggcgctgttgccaggctttctcctgtccctggctagtcggctcatagtaccggtgctgttttaactcaggtggcatcgtcgtcatcgtggttaatttggccgctgtatcatgggcatatttgtaatcagaaccataacctaaatctttcattaattttgtcggtgcgttgcgaatctgtaaggggaccggtaaattacccgtcgctttgatatctgcttgcgctgccgatttagccgcgtataatgcattggacttcggtgctaaggctaaataagtcactgcttccgtcaaattcacgtcacactcaggcataccgatcaactggcacgcctgaaagactgctaccgtcagtggcaatgcctgccggtcagctagcccaatgtcctcactcgcaaaccgaatcaaacgccgagcgatatacagcggatcttcaccgccggctagcatccgcatcaaccagtaaatcgccgcgtcaacatcactattacgcattgatttatgtaacgcggagataatattataatgctcctcgccatgcttatcgtagcgcaacgacttagtattgatcagttgcgataacccggccgtagtaatcgtaacgtgcttgccatcgcggtcaccgttcaaaacagccatttctaacgtattgagcgccatacgagcatcaccattagcaaattctgcgatcaaccgtagtgtatcaggctgcatcgtaatctcaagatccggaaaccccttcggattctgcaaagcgccctgtaagacagcttctaatgcatcaggcgtcaatgcctttaagaccaatactttgcaccgtgataatagggccgcgttaatttcaaatgagggattttccgtcgtcgcaccaattaacgtgatactgccgcgctcaacatatggcaaaaaggcatcttgttgggctttattaaaccggtgaatttcatcaataaaaacaatggtcttttcaccaaaatctcgattagcctccgcttcatccatgatttgccgaatttctttaatgccactcgtcaccgcgctaaacgtaataaagtgcgactgggtctgttgcgcaataatttcggccagcgtggtcttaccgactcccggtggtccccaaaaaatcagggatggtaactgatcttctgcgattaattgtcgtaatagtttacccgggccaagtagatgctcttggcccttgaaatccgccagcgtcactggccggacccggtaagccaacggactactactagatttatccgggttaaataatgattcttgtcgcatggcgacccccactttcgcgtttattcattactctcaattttaacgcaaacgtacgttctaatccactcaaaccaacgatcattaccgcacagccacccacagcacaaaaaaactgcgcctaatcacgcgtaacgtcattagacacagtttagttcattcaaaatgattttattgttcttcgtaccaactgtaatggtataacccttcacggtcagtccgttcatacgtatgcgcaccaaagtagtcccgttgcgcttgcaacaagttagcaggtaacacttcggcccggtatgagtcgtagtatgacaatgccgcactaaatgatggtaccggtacaccagcttggattgctaagctaagcacttcacgtgttgattgttgatacttggcggcgatgtcggcaaagtagtcgtccatcaataagttatttaaatcaggcttcttatcaaaagcatccgtgatgttttgtaagaattgggcccggatgatacaaccagcacgccagatttgggcaagttcaccgaacttcaagtcccaaccataatgttcagaagcgaaacgaagttgttcgaagccttgcgcataactcataatcttactgaagtagagggcttgacgaatcttctcaaccaattctttcttggctggcaagtcaacgtcagcggttgggccagctaatttcttagaagcggcaacccgttcgttcttcatcattgagatgtaacgcgcatagaccgcttccgtaataacggattgtggcacttgaacgttcaaggcatcttcggaactccacttaccagttcctttgttgttcccacggtctaagatcatgtcaacgattggcttagtcttatccgcacctaaatcatccttacgtgacaaaatgtcagcggtgatttcgatcaagtaactgctcaattcgcctttgttccagtccgtaaaaatatcggacatttcatcaacggacaagcccgcgacgttgcgcatgatattgtatgattcatcgattaactcttcatcaccgtattcaatcccgttgtggaccatcttaacgtagtgaccagcaccgttcgggccgatgtaagtcacacatggtgcaccgtcttgaggcgctttagcagaaatcttttccaagattggggcaactaaatcataagcttccttttgaccaccaggcatcaatgaagggccttgtaaggcacctaattcaccaccggaaacacccataccaataaagttgattccggatttatctaagcgggcgttacgcgccatcgtgtcattaaagttggtgttcccaccatcaatcaagacgtcgcctttatctaatagtggtaataattcatcgataacggcatcggttggcttaccagccttaaccatcatgataatccgtcgtggcgtttcaagtgaagccacgaagtcttcgatcttataacttggtactaattgcttgtcagcatggtccttaacgaccttttcagttttggcaccagtccgattaaaaatcgcaaccttgtagccgcggctttcgatgttcaacgccaggttcttacccatgacggccatcccaatgacaccaatttgtggtttttcattactcattagtttattgcctcccaatttttaatacgcaactatcgtaccaaaaaacacgctgttaataaagtaaatgaccgcaaattttaaaattaatttcatataatttatcgcgggaagaaattaattttcatagaaccatccaacaaggttacttgcttttcaaacagcaccaactgacaaagttaaaaacaccgtgctaggcttacagtaaaataaacggataaccttcatagatcggttcgtggtgtttaggctagtgtcctcattgttattatgacgttccgcactttttttattcgtacatgcccgctggtggccacttttaccagagagacaccctagcaccactaatcctgaccagcagtccaattcaagataagtaaggaggcccctaatcatgtctatccaacgactgccagattggcatcaaattgaacaacccgttgttatttcgcttaaaacggcccgtcaccatctctggggcaacgtggccgtttatttgggcttatttattatcgagcttctaggggcacgctggggccactcacaggccctacgtgcggatgcctttaataatttatctggaattttttcgaccgggctactcatgactggtctattcatcgccagtcgcacgcacgatgacgatttatttggcgcacccatcgcacccacggagcagcagcaattaggaccccgaatccagcaatcccgctttcgttttgagacgatttttaatttactagccggcaccatcatggctgccattggaatcgacattattatcaaaggcgtaatgacattcgccacccgtacccccttcaaaaacctcagcagtatcgccggcttggccgccgggttttccttcgtggtgctactggtcttatgggccttcaatcattattggagtcgcaaacttaacaatgctgccctgaccgcagcgagccgtgataccttcacggacgcgttgaccagtctgactaccgttcttacgatccttgtcacggtcaagctccaccttcagtggttcgataacctgattagtatcggcttagggctatacatcctcaatactggcaccaaaatttttcgagaaagtagtctgaacctagttgactatttcgacccttaccttgaaggtcgctatcaacggcgaattgctgatttaactagtgtccgcaaagtcatttttctcaaggctcattatgatggtaatctcatcatgctgcgagccacgatcgttgtgccacctcggatgacggcgattgaaatcacacgtctgattgaaaccatcaatcaaatcatgtggcaagaattcggtgtgatggaaacggacgtgatgattacgactagctattgatcaaatcagtgatttacaaaataggcgatacgtttagccggctgaccatttcaagactagttgctgacaaaatgaggctacataccgccccttttcaccagcaaccacgtggtactaatcgtcgtgctcagtttccaaaatatgaccttcataggcatcaatcttaatatcgacttgctgctttccttgatgtacctggacctcccagtaagtggtgccattgtccttatcgagcttgagttcgctagcatagccaccgttacgatcatggatggcaatcgccaccgctttactaggactgattaccttgttaagattcagccggtcaccctcagcgtcagcttgatcatcttgatccagcatctcagactgcttactgatgaccttcccggttcgcccattgagttgtaattcatgttcctgggtgccgccaacgccttccagcgtgtaaaccggtcgaccgagttggtcttctaactcaatactcgtcacactggcgtccggatattgttgctgaaactttttgatggctgcggctaatgacactttcgttttggctgtcacacttttggtcgaattactttggctgctagttgattggcttgtcgccttattttgcgtcgactgttgggtgccacatccagctaacagaaccacggtgagcagtgctaacccgatcccatattttttgctcatcatctccataacccccttgtcgctgcgtcagtaacacttattatgaagccgtacccattatttgatagtcttagtatacggaagggagacgcctcatcgcaatcaatatgcaaggccactcgcttgaccgcgctggcagctcagtcaaaccttatttcaagaagtgctggtcccgactcaaacttaattgaagacaacaaaaaaagcccacctaagcgggctttttgatcgtattatggtaacgaaaagttccatgcgccatggccgcaatgcaacttttcaccaactaacaattagttgtttacttttacgacttgcttgccgttgtagtatccacaacttgggcaaacacggtgtgatacacgtaattcgccacaatttgggcatggtgccaaatttggtgtagccaatttaatatgaccacgacggttgcgtttacgcatcttagatgttcttcttgctggtacagccatcaacctacacctccttcaagtgaattcacataatgtgtgttttgatacgcctagctaacttaatccttgtcttcctgatcagggaacaggttttttaacttagctaaacgcggatcaacagttttaagttctgcagcttgcaacgcttggtcgtcctcggagagaacttcccagcccttaccagttggcatcggggcgccgtcttgttcagcttcagaaagaatctgcatggggatgtgaattaaaatattatcctccacagcgacatcaaaatctaaaatatcatcttcaggtaaaataattaccgtatcagtttcttcgtcaaaacgactcagatcggttccctgaggaacataatattccgtcatttgaaaagccaatgggacatccactggcgtcagcgagcgactagacggcaatgttaacattgcgtcaatcttcgccgtgattaacacattatccttatcataactcgctaacccagttgcgtgaactgacttaacatcgataatttctggataacggctcatcaaggagtgttttaaatccaatgcttcatcaaactgaagtggcgtttcacggtatgttttaagctgtgaaagtgaccatttcatttaaaaacctcctaatgcaacgtgataaattatacctgtgtaaaaatcctttgtcaatgttttttccttgacagtccaaaatgcccgtcattagacctaaccatatcaagaaagcccgccgcggtcaaccaattgttaccggtaaccgccatggttgtcgatataaatcttgcgattgcccattaattaattgatagacgcgccccgcccgataatcgagattcagagcatgctggcgtaagtcttgattgattttcgtatacagcggcaacgggagctgtttcttcacttgatgcaaataagcctgccccttaggtgtgaagcctaagacgcgcagataattatgtgcctgtgctttctggacttctgcctgagtaagttgtagtagtgcggctgtcgccacccgctgcaatcgtgtatacgtatagcgttttgacttgacctgatgaataaagtcatcaaaagtcgtggcgtgttgggccatcgcctgcatccggtattccaagccttccgccatctgatcatactgtccactacgggcaacgtcaacggtcagcaattgatactgtaaaaacggccaaaagtcgctccagcgctgcagtcgttgcgtagtcagcgccgtgaacgtgtcggccgggacaactggtttcagcgccgcccaatcctgtgcaagtgccgcttggcgcaccgctgtcccactggcgtagcgactatcggccgcaattgtcgtcgtcgcgtgatccgcttggcgacgcttgatcggcagtaactgcatcggatgtgccagggtctgattggcagcgtaataacagaagctcagcatatcattggctgccgtcaacgtcacgcccgtggcagcttgcaaggccgcgttaaactgagtggcaaaagtctcattataatgggtaaagtcgccctgttgcgccgcaattgccgtggccaaccgttgaaagtccagctcaggatgttccgcaccaaaaacaacactcgtacagtccagtgcactgagtagttcaataccaccccgtgcaaataaatgggcaggttgggtcgcaaaaaacacgggcagttcaattactagatccgccccattttccaaagccagcttcgcacgtgtccacttgtctaaaatggccggttcaccgcgttgcagccaatcaccactcatcacaacaataacacagtcggcattggtcaactgttgtgcttgccgcaaatggtagcgatgcccattatgcaacggattgtattcagttattaacccgactgcttgcattcttgttcctcctactacttacgacacttgaagaaccaccgcgtggtctgatcatccggttgttggcggccaaaatcggcgctgaccgtgacatgattaaaaccggctgcctgcagagcttgttgataatcagccaacacataagtttgttcttgatgtaattcactgacctcgtcgaaggcctgcttatcatcattataaataaagaacgttaaatcgtgctcagcactgtgcggctgttcaccggcatagcttgtccacataaaagcccgatcctcatcgcgataattgtacatataaccaggatagacctcatccgtctgataaggtgtaatgacgtcgaataaaaattcgccggccgctgtcaaatgttgagccacttgttcaaatgcacgttggactgtcgtaatatcgggcaaatagcagaacgaatcagcaaaacaggtaaccgcatcaaaggtcccaacttcagataaatcgagcatatccccttgtaatagcggtaaggtcacggctgcctcgtccgcatggcgctgtgccagtgctaacatgttctccgacaaatctaaaccggtgacctgatagccggcttgggctaacaacacccctaagcgtcccgtcccacaagctaattcgagcaactgaccatcttggttaggatactcacgacggacaaaatccagccattgctggtacatggctggatcaaaaagttcgtcataaagttcggcaaacgtctgataaatcatgcgtttacccattgtgcaacgtcgacgatgggcgcatcagaccataatttttccaaattatagtgtgcccgcgcatccttttggaagacgtgcacgatgacgtcaccggcatcgatcaagacccattcgcccgcagtccgaccttcgacgctcttaacgtccgaaccggccttgcgcacaaagtccacgatattatcagcaatcgcttgaacttggcgcttggaatccgcggataagatgacaaaatagtccgccatcaaactgacttccgcgacgtctaaggccacgatatcgtcggcacgcttatcgtcagcggcctcaacagttaattgtaaaagttccttgctatccataaaactctcccttaaatttaattggcaaattgaggggccacaccgccgacccacgcgttataggttgctaacgtttgtgggtagactggcgcacccttctgaatcagataatctagtgtatgttgaatctggaaacgaacaccgtcagccaacgacttggccgtcgcttcacgagccgcttcaacaccggggaagtcccgggctggttcaataaaatcggccatgaagatgatttggtccagtttagtcatataaggcgcaccgaccgtgtgtaaccgcaccgcattcaaaattggctcattgtagatgtgcaactcatctttgatcagttcagcgccaacatagccatgccagaccccgttcccatacgaaaccaggttggggtccatgccatgcgtcttaatgagctgaataaatgtttgatcatcgcgttgcttggcgtagtcgtgtaataaccccgcaattccagctaactcgacatcaacaccgttgtcagcagctaactgccgcgcagtctcctcgacccgtaagcagtgttgatagcgtttgtcagtcaactgggcggcaacttttgccattagctcctcgtgacgatatggaacaatcgcttcagtatactcaatcgttttgctcatacaaatgatgctccttaatataagcggccacggcttccggaaccagataacggaccgaatgcccatggctgattttttgacgaatctgagtggaactaatatcgatcaacggtgcgtcgacccaaataaccggatattgactcgtcgttgggtacccggtgcgtttgataccaacaaaggtgactaatttaactagctcgtcaatgtgataccaagtatgcaaataatcgaccatgtcgccgccaatgatgaaatagtactgcgtgtccggatgcttagctttcaaaaacttcatcgtttcgtaagtatagcttttgccaccccgctcgatttccgccgtctccaaccgaaatagtggattatcaacaatggcttcttggaccatattcgcacgatcttccaccgcaatcgtcttcttttcgtcgacatgcggtggttgagcgtccggcataaagcgaacttcatccaaacccagttgatcaccaacttgctgggccatgatcaaatgtcccaaatgcggtgggttaaacgtgccacctaaaataccaacacggcgatgcggaattgccgtcaccgtttccgtcagaacttttgtcgctgtttgattaaccgtctgcacccgtcattcctcctataacttagcaacttccaatgaatagtgctggtcttcttcatgactagctggcaagtataagactaacacccggccaattgtttgaacgaccgtaatcgcggttttctgttcaattgcagctttaacttcagccgttgtcacatcagcattttgtaaaatgttgactttaattaattctcgcttatccagcgcacccgttaattgggtcaaccattcgtcagtcaagccgtttttcccgacagcaaatagtggccgcatgtggtgggcttcaccacgtaaatagtgtttttgttttccacgtaagttttccattaagtttgatttactcctataattttctgtttgataatcgcgaatcagattctactccgaccacaactcatcaacgcttgttgatcatagctgggcgcgtcaagactgcaacaccctttggtgcccaggccgctacacgcgtatccgcagccaccgtgacccatccgaggccttcaaagacaatatcactgatttccgtcactttgaattcgtggcgaactaatggtggaaagtcagcgacagcatcgccagttgggggggtaatcagttcacccacatgcttggtataaaagttgtccgcattctcggtccgggttcggtgcaaggtcaagttattatcaacgtagaccgtcccagttgcttttaacgtatcaacaatatctaaccgtgccaccccacctaagaacaaagtttgaccgttgcctaattggaaaccctttgggcgaatctcgcgttgtggtgagactaacttcaggtcatcgcctgataacacgtgggccatctgttcaggatgaataattccgggtgtatcaaccatcatatgaccatcatccaacggaatttcaatcttgtctaacgtggtccctgggaaccgggatgtcgtgatcaagtccttcaaaccagtattattggcaataatccgattgatcaacgttgacttaccaacgttcgtgacccctacgacataaacatcgcggccacgacgatatttttcaatcatcgccaagagctcatcaatggaatgccccttcttggcactcgttaacgcaacgtcaaccggtttgattccctgtgcacgaacttgttgattcatccattcccgcaatttcgtccggcgtaactgacgtggcaacacgtcttccttattaccgactaacaaaacgggattatccccaacaaagcgctggagaccaggaatgatgcttccattcaaatcaaaaatgtcgacaacgtacacaaccagtgcgttcgcatctctaatcgtggctaacaaatgacgaaaatcatcatccgttaagccaaccggcacgatttcgttatagtgccgaagccgaaaacaacgttgacagtataaatcctgtgcgtcactagctaatgatttttgtaacgcactgttcggtgtgtagccggccgccttaggatcggtcgtttgaatcgccgcaccacacccaatacagtataaagtttcttctgatgtttcactcacttattaaggtcctcctgaaaatgcatttctggataaacatgtgctaatcgtaatttgataaatcgttcaaagaaacggtttatccgggtattccacgcgtccgtcttcacgattggctgtactaagatactgggcacgcccgcaagatgggccgcccacatgtcggtgatatactgatcgccaaccatgaccacttcatttttgtgtaagcccaggtcatgacgcgccttactgatccccagcggtagtggtttcagtgaccgcgaaacaaatggcagttccaggctttgcagcgccttagcaattcgcgcttcggaattgttcgacaccaccactaacggaatgcccgcgtcttgtaacgcgtgcagccactttttcagttccggggtgccatccggattgtcccatgcgatcaacgtgttatcaaggtcggtaaataccgccttaatgccctgcgctcgtaactgcgccggtgtcacattgtagattgctggtatcatccaagttggtttaaattgcttaatcatcgttatccccttcgcttctcactggattttttggttattggcataaccccactagcccattttatcatactattggtgaaataccggactaaatcaggtctggagccggagttcactaggcaattgtgctaaattttagtcatcattatataataatttgttttttgaaaataagcaacgaaaatccttccaagttgtcgtaacttgatgacaccacctggatcaaatttgactaagttgatcgcacccgcatttatttgataggttggggcccgagtaagacattgaaaatagcactaaaagtcgccagtaaattcagcgctgttttgccggttgcccttttctcgccagtttatttgcaatggctaaaccacaatctgacattcaatcggcgcactgaccgttttgtcaaattagattaacaaagtatcccattaagtgtatattaattaaagatacgtggcttttacttatatcatgatactgatatgtatattgattgcacatcaatgcaatcctcatgtaagcttattgacatggttaaatgttcagattgttctaaaactgttcatcgcagttaatgttaggcaccctggtgttgttctatgtcgataaactgacaatatcagtaatgatataaactatatgatccgcacgatcactaaacaatatgtcatctcggaggttcgtttatggagaaaaaagatgttatgaaacaatacgttaccgataaatatttttccaaggggcactggtggacgaaactttggcaaaccctagtcgcaattattacttggatctgcgttgccgtacctgtctactggactatctcgtcaacgttacttgcgaataatccccagttcattcacgcctggaaatacgaagaaggtaagacgctgttctacttttttgaccggttctttattattgcgtttatcttaatcgccattgtggtcattgtctccacgattcacaataatcaccgggtcaagcagcatatcagtaaagaacggcaatacaacgaagacctgttagatattcggaagcggcaactaaataacttttatacccaacgattcgggcaggccactttccggcaacacgtcaagcactacacggttgaccccgaacaaaatctcgatgttaacgaaatccacagattgtatgaggactagccaatggaaataatgcaaacacttaagcccttcgaaagtatctggaactttgttctattattattagtctcctacccgattctcggtgcgtttgcctggtttatcggcgttctctgctaccagctgatttaccgtcatcgccacaaagacgatattgaatttcaaccgctaacgcctgaagaacaaccctttatcacgatcatgattccagcgcataacgaagaagtcatgattgaacacacaatcaactatttaatgaacaatttaaattatgaaaaatatgaagtgctggtcacagacgatggttcgactgatgagaccccagctattttagaacgtctccagagcgtgtacgacaacctacgcgtggtaacaatcaagaaaaatcagggtaaggcccacgcgttcaacgtcggtgtcggctttgcccgtggtgaattcattttaagtaatgacgctgattccattccagaacccgatgcactgtggaaatatatgagttacttcatgggcgaagaacacgccaatacggcagcggtcacggccaacatggacgttcagaaccgaagcacgatcatcgctaagtcgcaaaccgtagaattttcaagtatcgttggtgttatcaagcggagccaagtcagtgctttaggtaacatgtatgcctatagtggtgccaatacaatgtaccgtcgtgacgctctgattgacgtcggcttattccggcaagatcgcgcgaccgaagatatcagtattgcttgggatcaccagttgaatggttggacgaccgttttctcgccagacattctattctatatgaacgtccccgagaatctagacgccctttatcatcaacgcaaacgttgggccaaaggtggtaccgaagtgctgttgaccaactttaaacgggttgtcagtcatcccggtaagtatttgaagcaatgggcttttattactgatcaaacactgagcatcatctggtccctattcttctttgtctcaacactgatcttcctgatctcgctcgtcaccttcttctttactggcaattacgagcgcgtctatcatatgttctgcatggccttcatcttcgtgaccttcgaaatgttcgccggcgtcttgcagctattgtccgcattgatcgttgacgaccgtggccgcaagtttaaatatctgattttcatgccactctacatgctgatttactggcaggttaacgccctcgctctggtcactacgctgattccagccgttaaaaccatcctgggttacggcagcggcacctgggtcagcccagttcggaagcaccacactgaataatcgagaacacaaagcgagccttcaattgaaggctcgcttttttgttgtgcgggactgtgtggagacggacccaaccttgcatgtgcgagaataggctagttagcaacgatttgagcgcttacaattttactattcttcatgtatacgaaagtggtgttataacagctacaatcacacgtactaaatagatcaaaaatcatttttatccagttacctgcaccctcctaccgcctaatcgatggccgccgacgaagtatcaacgctggcttagttgcctgtgcgcgttggacggttgctcgagctagttcatactgtgcgtcaataattcgttcagaatcatatggcgcagcatcctgagccaccgacaattcggtgcagccgagaatgacggcgtcacaatcagcagcattcaataattgatcaattaagccatgaaatttgacccgatctacaaaatcacgttgcttgatgtcgtcataaattaaggtcatcacttgagcttgctgctgcttattgggtatcacaggaatatgtccattagaccgaataagttgttgataaagttgcgactctagtgttcccgttgtcgctaaaataccgattcgtaacggtcgcggttgctgtgatcgacaggctgctgttaccgctaaggccggcatattcaaaattggcacgttagaaagcgccgtcaatgcgggaatgaagtaatgtgctgtgttacacgtcatcacaataaacatgacccctaattgattaagtagctgcacatccgcttccaatgatggtaacgggttggcacagttatgatccaaaatatatgcggtgcgatctggtatctcagcatcatttaaaatgacgtagtttaaataatcctggtcacgatgggtaacggtcagccggttcacggtatgcacaaagtcctccgtcgccattgttcccatcccaccaatgattccaaagcaatttttcataatggcacccccatttagcgaacgagattcacggccatgctgcacttcattaagttgttaataattatctaacatgcacctcctaacaagcaactaatccacaacctatctcagacttaatacggtatcattgcttactgcaaacccatgattattcaagaaatgctgccaaacagtgatctatcggtgtactttttacatcagactcccgttttattagattagaaaacaactaggctagtaaaaaatcacatcaattctttactagcctagttaaacagtcactattaatgcgagcaaggcaccaagcacaatcgcccctaacaaaaccgacaacaattccatgaaactcacactatgcccgttctcacattcctattgacgaggttttccattcactgaattatactgtcggccccacgtctccatagccataatcaccggtttcaaggtctgaccaaatggcgtgatccaatactccgttttcggtggcacgaccggataaactcgttttgcaatcaccccgtcttgaaccaattcttgtaactggcgagctagcatccgccgcgaacaacccggcagtcgtttttgcaaaatgctgaaccggcatgttcctgccgtaaataaatgatacaaaatcacgctcttccacttgccggcaataacttgcaaggtactttcaaccggacaacctggcgtacaatcgtatacttgtcgctgcatctaacttcccctaccttaattaagtgtcttgattgtagcacaactttgccgtcagaccggactaataggcgtgacaaatatgtccctatgtggcaaataattcacgtcttgtttattcctcactggtaacctatagtaatgtcatgaaaggggtttgattaataatgcatgcaattggttttaccgaccacttacctattgaagatcctgctagtctacgagacgtgacgatttcaaaacctagcgctcaaggtcatgacttacttgttcaagctcaagccgtcgctgtcaatcctgttgacgttagcgttcgtaaaacggggcatgagcacctcatgcgacccaagatcctcggttgggacgccactggtattgtgaccgctgttggagaagctgtcaccctgtttcaacccggcgaccacgtcttttatgctggctcatttagacgtcccggctgcgacagtgcttatcacctggttgatgaacgccttgtcggtcacgccccgcgacattaacaaccgctgcccgtgcggccatgccacttacttcgctgaccgcatacgaggcattatttgaacaacttcacattccttttgacccagctaaacctaattccgaaaaatgcaatcaaaccattctcatcatcaatggcgctggtggtgtcggttcaattgctactcagttagcaaaattagcgggactcacagttattagtagtgcttcacgacctgaaagtatcgcttggacgcagcaacacggcgccgatttagtcgtcgatcatcatcatgatttggttagtgaagtacatgctttaggtattaaagatgtcgattacatcctcggattaagcgatcttgacagtcactggaatgagatatgtacgctcattaaacccggtggccacatcgcatcaattaccgaaaatcggcgtccaatcgaccttaaaaaactaaccaagaaacgcgggacatttgcttgggaatggatgtactcaaaatcctactaccacacggccgacatgattagtcagcacgatatcttagaaaccattgcggatttacttgaccgtggcttgcttcaaagcacgctatcgcagacactacggccaatcaacgcgcttaacttgcggcaggcccatcaacttatcgagcaacatcatatgattggcaaggtagttattgaaggatggaaatgagttgacgggtattacggctcgcgcgataatgatcaactttaactcgccaaatacgctgtccttttctgtcttttagtgcttacaactgatgttgcactccccgggattcgtttaatctgttttccgtatacacggggggtaattccaagctattaatctccccaagctgactcaataccatctacgaaacaatatcgcctttctcattcatcaacaagcatgaaaacttaaatcaatacgccttcaacccatcactcgagccaacgtcaaacctatggtatcagactcactcatttcagcatcgttccccgctaacctgccaaactttctttttcagtttccaaaatattagtgctatgatgatagcatcaatttgactaaaacacttaatcagaaaggactttgaaattggcatttaaaacaccactggctgatcaaatgcgcccgcaatcactggaacagatggtcgggcaacaggatctattgaaggcaggccagccattacgccagattattgatcaacatgttaatattcccctcattctgtgggggccgccgggaactggcaaaactagtttggcgcagattattgcgagtcaagacgattatccattcgtggcttttactgcttcgaccgaaaataaggcacagctgacgaaagccatcgcacaatacccagagcaatcgtttgttctattaattgacgaaattcaccgaatgactaaaacattgcaggattttttgttgccctacttagagaatgggcacgtgatgctaattggctcaacgaccgaaaatccgattatgtcaatcgttccggccattcgttcgcgctgtcaaatttttgagtttcaaccactgagcgatacagatatcgagattgctttacgccgtgcggtaaccgacatttacaacctaaccgacgatcaggtggatgctaaagccctcaacctgatcgctatttcggccgaaggggatctgcgaattgcgttaaatatcttggaaacgctccacgctattgaccagaagcaaatcactgttgctgcggtacaacactttgcccagcaacagcattttagctacgaccggaaggcaactaagcattatgactatctgtcggcttattcggattcgatggctggctcagatactgacgcggcgctctactacttaaccattttgttaaaaaatgatgacttaccctcagtggtccgccggctacgtgaaattccatacacttatatcggcttagctaacccggaacaggtcacacaaattgtggtcgctgccaatcaagccgaaaagattggcatgcccaaagcaaaatatccactaatgtttgccaccatgctgatgtgcatttcacccaagtctggttcgtttgaccaatcttgggaaaaactagaccaggacacacaaaatccaagtcagcaccccatgccccgtggattgcgcgatatgcactacaaacactccgagaaaattacaggtggtggtctgatcgataatccattccaaatgccacatcagattgcccaacaaaactacatgcctaaaggattggctggtcgtcgttattattaccctaaagataatgaaaatgaacgcaaactcggtgcacaatacctaaaactgcatcgctttatttataacgaagattatcacgaatagacaatggcagactggcttaaccaatcagaaatcacactcgattttcataaatcagagtcgcgcactaaatggctcacttaggccgttatccacgtatactccaagcggcatcaaaaaatggactcagtcaaatgaccaagtccatttttatttggcatcatcttttatgaatcagtgcacgccagagaccaagtcaattcgcgtcacactattatgccaaagttcttgggccgtataaacatccttttcgaacaacacgacagtgccatccggttcaatccgagcattggcacccaaccattcccaagatggcattaaccacaaattgcgccgcttccccttacccttttttggtgaccacgcagaaacatagtcatcaatgaaatgtgtacgcatgtattcgaaactccccattatcaaactcaatctgcaagatgttggcgcccatccagaccttaactgctttaggtaaaactgttgccatgatgacaccccttctacaaagctcccagccaaataattaatcaacacataagtaaacgcttacatcgttactatatcacaataatgtgtcaaatcaatctcaagattcagtaaggacgtcaacacaccgaaccatcttgtccaggaatcgtgttcccttaatcaagcgtcaaaaaaacggccgccacccatacaggatgacggtcgttcaaacattagagcaagccctaattaagttttaaattaagcaagtgcctttttagcagtgtcaaccaatgccttgaaagcatcagcatcgttaacagctaaatcagctaacatcttacggttaacgtcaacgttagctaactttaaaccgtgcattaattgactgtagctgatgtcgttaatccgggctgccgcgttgatccgggcaatccaaagacgacggaagtcactcttacgccggcgacgatcgcggaaggcgtataggtatgacttcattacttggtccttagcaaccttaaattggatgtgcttagcaccacggtaacctttagctaattttaaaatccgtttgcgacgtttacgtgttacagttccaccttttactcgagccatgttatttcctcctagatttaactaaaacgttgtgaattatttttgtaataacttgtggtatgtcttgaccattggcttttcgataatagccgtaccacgtaattggcgacgttgtttcttagtcttaccatggaaacgatgactagtaaaagcgttggcgctcttaatcttacccttagcagttaccttgaaacgctttgcagcagcgcggtttgtcttttgttttggcataatcaataatcctcctagaaattacttatctgtttttggtgctagtactaggaacatactccgaccatccatcttaggataggcttcgaccgtagaaaattccttagtagcttcaatcattcgatttaagacttgccgaccaatatccttatgggtaatagcgcggcccttaaaccggatggagacgcgaaccttgtcaccttttgacaagaacttttcagcatgtttcagcttcgtgttaaagtcattggtgtcgatagctgggctcaagcggacctctttgatgctgaccactttttgcttcttacgggcttcccgatccttcttttgttgctcgaaacggtacttcccataatccataattctggccacgggtggtttcgctttcggcgcaaccaatactagatctaaactagcgtcttcagcaatctgcattgcttcttgtcgtgacttgacacctaattgttcaccatcgctggcgatcaaacgtacttcgcgagcacggatgccgtcattaaccattgaatctttagctatggtaattcacctccgaaatattttagagaaattcacaaaaagagcgggcgcatagtacgcccgctcaaccccgttaatgggaatcaattcatcgttcatctgcccgatgactctggtcaccaaggcgagaagcgggtgcttctgctttttttctcaactccaatatattaacaagaaccacggcccttgtcaacccatcaatcaatattgatgccattggctgttaattatttgcttgcaccacgactgtaatgcttgatttcttgcgtgatggcaccaatgaacatgtcaacggcttcggattcagtccgttcttcaccgtacttccgaactgaaacactcccgttagcaacttcttgatcaccgacaactaacaagtatggaaccttcttcgtttgtgattcgcgaatcttgtaacccatcttttcgttacggtcatcgatacttacccgaacaccttcagctgccaaacgacgacgaacggtttcagcgtaggcaccgtgcgcaccattgttaactgggatgattgttacttgcttaggtgctaaccaggttgggaaagcacccttgtaaatttcagttaagtaagcgacgaaccgttccatcgttgaaacaagaccacggtgaatcataactggacgatgttcttcaccatcagcaccaacgtacttcaagtcaaagcgttctggtaacaagaagtccaattggatagttgataaggtttcttcaccaccaagggccgtcttagtttgaacatccaacttaggaccatagaaagcagcttcaccttcagcttcgaagtaatccaagcccatatcatccatagcggacttcaacatcttttgactgcgttcccacatagcgtcatcatcgaagtacttttccttgttttcaggatcacggtagctcaaacggaaccggtaatcagaaatgtcaaagtcttcgtatacttcaaccatcaaactcaagatctttttgaattcttcttcaatttgatccaacgcaacgaaggtatgaccatcgttcaaagtcatttcacgaacccgtgataatccagttaaggcgccagacttttcgtaacggtgcatcatgccgagttcagcgatccgcaatggtaattcacggtatgagcgaatgtgatggttgtaaatctggatatgtgatgggcagttcatcggccgtaattccaattgttcgccgtcacccatgtccattggtgggaacatgtcctcacggtagtggtcccagtgaccagattgcttgtaaacgtccaagttagctaaaactggcgtgtatacatgttggtagccatttgcaacttccttgtcgataatgtaacgttcgatttggcgacgaatcgttgcaccatttggcatccagtaaggcaagccattcccgaccttaggatcaacgaagaataagtctaattcgttaccaatgacccggtgatcacgttcgcgggcttcttgacgccgcttgaggtcagcatctaagtctttttgctttaagaaggccgtcccgtagatccgttgtaacattggattgctggacttaccttgccagtatgcaccggcaacggataataacttgaagaccttgactttccccgttgaagctaattgggccccgtcagataaatcaacgaagtccccttgcttgtaaacaacgacttgatcattgttggcagcggcacgttcgttaactaagtcttgttggtaagggttgtcaccaactaaagctaaagcgtcagcctttgataagacttcgcgttcgattggtaaatcttgtttgataattgcagccatcttatcactgatggcttccaaatcatcttcactgacttgtttaccgtcttcgtcaggattgtcggtatcaaagaagaaaccgttggcattcccttcaccactcccaaaatgaatgttagggaataattgtttaaccgcgttagctaatacttgggcagccgtttgccgtaaaacattgaggccgtcttcactatcagcagcgataatttcgatactaccatcggttgtcagtggttggcgatagtccacgatctgatcgttgaacttaccagcaaccgaccgtttagccaatgaaggactaattgactttgcaattgcttccgtcgttacgccggcatcaaattgcttttcagcaccatctgggaacttaacattaatacttgccatatacttgacactctccttaaaatttacccactcaccaaaacaccgcgccgggacgacaaaaaagtccctaatgccagactgaactagcattagggacgtcattgacgtggttccacccgatttttcagtgtcatcaaagacactgactcattagcgctaataacggaagcgttccggctcaattgagcatgttcacaaaagtggtatcttcgtaaacccggtccaagacttccagaacaaggtcttggtctctgcaatccatggtaaacaaagcgtgtcttttgcatctgttttcattaaaccacttttaaactaaaagtcaactcttgattttaagcatcgggattgagtcgtcgattacgaccgaccatctcaatctcactcgcaaggtaacgtacccgttgcatgattcgctgcgctttgactggttcttcatcacccttttgtgagagcgtcaaataaccatcttgcaattcttgcatcgaaaaattagacgagaaacaagttggcagttcctcctgcattcgatactccagaataaccccgagcacatcgtcccgaatccaagtcgacgaagcatccgcaccgatatcatcaatcatgagaatcggtgcccgtttaatcgcatcgaccttatccgccgacgtattgttactaatcgagcgcttcatctcgaccgcaaaactcggaaaatgaatcaaggtcgtattgaaacccttagctgccaacgcgttcgccatcccaccgagtaaataagttttaccgacaccaaatgagccgtagagatataagccccggtgaaaacgcttgggcgcttgtgtataggcatcaataaaatcaagtgctgccattaatgctgtcgcccggtcaccatcttgatcatacatctttaagtccgccgtctgaatatttttcggcatgctgattgatcgaacccgctgttgcaatgcgtgagcagcttgctgttcttgcatttgtggtgttggctgataagcaatgtcaatcaagtgattactcatcactaatgtcggctgatacccaggtgcttgagttggctcgtgccgcgcaattttacgtttctcttcacaaaattcatataatttagccgctgaacgttctagcgcatccgaagataattcgttttgatgagcagctaaaaactggcgaacatctggatcttggtacacagctgtcattaacgcctcataccgatgattcaagtttttccgattcattaacgtccggagtgtttctgagatattctccatgttttagtcctccttttccgaatttgtctcaagctttgctagtcgatcagcaagctgtttgcgttgggcagcagtaatttgtttaccggtctgagctggttgcttaccactctcagtctgttgctgttgttgggcccactttggcataatctccttacgcgtcggtcgattgttcttgcgccgtgttggtgttgatttcggctgtttacgttgcttcaaatacatcaaagccgcttccggcgtcgtaatgccgtgttgttgccaatcattggcgactgtttctagcaaattacgattaagggcagctaactcccgattttgcaataagtagtagatcaccatgttgatgacggcattgggtaataccccccgaccaattaaatcatgaactagtcggttctcaccgctcgtcacaaaaccatgtttctcctgcttcaaagctgataaaaagtcatacggcgctgtctgcttagcatacgtcacgagttgctgctcagccgttgagagctgtgctgaagccttgttatccttagtggtcgtcgttgcaaccgttgcttccgtagcgacctgctgactcgaaactgcgggccgttcatagcgccgcgcaatcaataatttcaattgattttcatcaaactgacccgttgttaaactagccacttcactgattaacttagccatctcaatctcactgatgccgtagacccgactttccgtaatgatcagttgccgtgaactcgcaacctgtttgagatcaacatagttctgcttcaaaatttgccccaacagttgccagtcaaagtcatcgtcactgagcacgggcgagtgatcctcggccggttcattggccgccaattgggcgcgcaccttttgcactgaaagaggtggcgtcgtaactttttgactatcaacgtgaaacacatctaagatatttgccgtcacgtctttggcagccgtcaagtcaatcggctgtgctgcaaaatcgccagcaagttgttgataacgtaactcaccgaccgtatctaacaataggacactcaatagatcatccgcaaagaattgtaacgccagtaatggtgcttgtaattgataaatgtacatggcacccaattcatcttgttgataatagctgcgcaacaagccagttgcttcaagtttacgccgagccgctaacaccgtcggcaagtccacatttaggatgcccagcagttccgcgtgactgcgtcgattgctcagctcattctcgctactctgtaagctacgtaacgccgcgtacaagctatatgccaatggccccatcagtggcaagtataattccgccaatacagcttgttgcgccgcactgagcgctggtgcttgcgggaccactaacccagttttgggtgttaagggttcatcatttggcatgttgttcaccattctttttaactaatctttttttcgtttaggtgcgtgggtcgtcttcgctgacggttttgccagtttgaccttatcacgctccatcatatcttggagttcattcaagaagacgtgcatatccttgaattgccggtaaacactggcaaaacgaatgtacgaaatttcgtcaatatctgccaattgctccatgacatactcgccgataacttggcttgaaatttcattttcgcccagtgaccggaccttattttcaacatcatcaacgacgcccgtcatggtttccatgctaacgggtcgtttctcggccgagcgaataattccgcgcaagactttttcacgattgaattcttcgcgggcaccatttttcttaatgactaataatggcgtggcttcgacccgttcaaatgttgtgaaccggaacccacagttttcgcattcccggcgccgtcgaatcacgcgaccatcatcagttggtcgactgtcaaccacgcgggagccattatgatgacaatgtggacattgcatagacttctcaccccttgtaacaactaacaatcagtttttctttatttagtaatagttttcagccattttaacacggctgctttagttttatcaatgttggccccgttatcaatgacaacgtcagcccttgcgaccttctgtgcaagtggcatttggctgtcaattcgtgcctgagccgcctgttgcgataagtggttacgcgccatcaaccgctgcaatactacggcgggtgatgccgtcacaaccaacacttgatcacaaacatgttgccagccactttcaaataacaacggcacatctaaaataattgcgtcgggctgttgctggtttgccgcgacaatcgcttcgaacatcgcgtactgaatcggtaaccgtgtaattgcggttaagtcttgtaaagcttgagcatcgttaaaaaccaactggccaagccatggccgattcagtcgcccgtctgccagcactgcttgctgaccaaagtgcgccacaatcttttgggtcgtcggttggcctggcccttcaacctgccacgcgattttatccgcatcaacgattggtaacttagttgccagcagcttagaaacagtcgacttaccagtggcaatgccaccagtcaatccaatcaactttgtcatcttgatcacctacaaccgttgttctaacgggcaaaaatgggtccctcgctgtgccactttgattttctcaataattgtgccacaccgttcgcaaggttccccttcacgaccatagacgtgtaagtgattttgaaactgaccggcttcaccaaatgccgttgaaaatgaatgaacagtggtgccgtgacctttaattgccatcgccatttcatcaataatgttttggcgcaatgttgcaatctcatcagtagttagtgaattagcaggccgcattggatgaatcttactcatccatagcgtttcgtccgcgtaaatattcccaatgcccgcaatcttactttgatccaacaatagtggcttgatcatctttttcgacttgccaaaagtggccgtcatataagccagtgttaactgttcagcaacgggttccgggccaattgtccgcaatcccgccaccgtgttttcttcaccggtcggcacgagcgtcattcgcccgaacttacgcgtatcgttgtacagcaaatcacgatcatcggtcagatggaagatcacgtgcgtgtgtttaccttgatcttcaccacgcggtacaacattatacttgccttccatccgcaaatgcgacaccatcgtcagaccattgctaaagcgaaacaacaaatacttcccccgccgatcaatggtctggatcgtttggttggctaaacgctgtttgaaactatcgacatcattattaataattttcggccaaaaaacctcgatactagcaatcgttgccccgctaaccagacgatttaagccgcgacgaacagtttcaacttcaggtaattcaggcatggtggttccccctattttgcatcgtaccaagtatcaccgtagtggctctcaacctttaacggtacggctaactgtacggcggaatccatcacgcttggcactaatttttctaaaactggaatttcttcttttggcgcttcaaaaatcaattcatcatgaacttgtaacagcatggttgctttcaaacccgcagcctgtaacttatcttgcatcttaatcatcgcaatcttgataatatcagccgcactcccttggatgggggtattcatggctgtccgttcagcgaatgagcgttggttgaagctcttggaattaatatctggcaagtaccggcgtcgatgtgaaatggtttccacataaccttgttttttcgccgtttggacaatttcatccatatactttttgacacccggatattctttgaagtaagcgtcaataaagctgcgagcctgtttacgcgtaatgccgatattttgtgacaagccgtaatcactaattccatagacgattccaaagttaaccgccttggcttgccgtcgaatatttggcgtcacctcttcagctgagttcaaatgaaagattcgcatggccgttgcggcatgaatatcatcacccgctttaaaagcggcctgcatattttcatcatcagtaatatgcgcgagaacccgtaattcgatttgcgaataatcagacgagaaaatctgccaaccttcatgactaggaacaaaggcttgtcgaatcttacgtccttcttccaagcgcaccggaatgttttgtaagtttggatcaacggacgataaccggccagtttgggtcaacgtttgcaagtagcgcgtatgcactttttgatcagcagaatgaatggcatctaacaaaccgataacgtaggtcgattgaatcttcgagatctgccgatattgtaaaatattagcgacgattggtgcttccggtgctaacttttctagaacgtctacggcggtagaataccctgtcttggtcttcttgattacgggtaatttcatttcttcaaacaagatgtgacctagttgcttaggtgaattaatattgaactcttcaccggcttcttgataaatcgtctgttcaatttcactcaaccgttctgtaaactgactgcccatggctttaagtcgactgctgtcgaccgtaatgccggcgatttccatctgagctaagacattagccatcggtttttcgatatcatcgtaaagttgatcctgctcattggctgccaattcctttaataactgtggcttcaaactagcgattgcggccaatttccgggcgagatgactaaagaagacgtcatcatcttcaggaatggcacgcttaacgcccttaccataaacggtctcgtcactcggcaagtcagtgtacccgtgttgctcagctaaacttcccaagtcgttactgttatcatttgtatctaataagtatgaaacgagtaagagatcaaagtcgactttacctagctgaatacccaaacgattaagcccgaccgtcgtgcgtttcatatcaaaaacgtccttggtaatcgttgtgctactcaagaggtcagccacagtcggttgcattaataattccacatcccgactgatgtaccagtgatcatccgctccgatggcaaagccagcaaaggccgacgtgtggtagtttggcgttggcatctccaagtaaaagtccacgtggtcggtaaattgttgcaattccgtcaggttagctttcgtcaagacggtataatcaatgggcgttgctggttcgtccgactgtaggtgtaatttcttcaaaaatgattgaaagtccatcttctgataaaacgcggccagctggtcaagatccgggccatcataggataaatcagccaattgaacatcaatcggcgcatcccgcttgattgttgctagcaccttagcttgcgccgcttgttcgcgatcctcaatcagatgttccttcatcttgctctgcttcatggcatcgatgttttcataaatgccttccatcgtaccatactgtttgagtaatttaagggcggtcttctcaccaaccttggtgacacccggatagttatccgaggtatcacctgtcaaccccttcatatcaataatttgtgccggtgtgatgcccagcttttcttcaacgtgcgccggcgtatagcgttccacttcagaaacacctttaacggtcacggccaccgtggtatgctcggtcgtcaactgcgtcaaatcacggtcaccagtgacgaccgtcgtggtgtagccggtttgatccgcttgaccggccagtgtaccaataatgtcatcggcttcgtagtcttttaattcataatgtttgataccatatgcgtctaatagctgtttgatatacggcatttgttcagaaaactcactgggcgtcttagcccggccacccttgtaattatcgtacatggctgttcgaaacgtggtcttacccgcatcaaaagccactaacatatccgtgggttcgactgccttgatcatgtggtcaagcattgtgttgaagccataaatggcgttggtatgcaggccgtctggatttacgaaccgttccagttgactatgcaacgcaaagaacgcccgaaatgccacactgttaccatcaatcagtaataatttttttgccattagtttgctccccatctcttaatttaaatcatcatttttatgaaaatccgtcactcagaccattaataccactcgattgacggtctgattcgcagcgcctgtcagtacaggctgaacgactaattatttacccttataattgtaccaaacaattaagtaaaacgggagttcggtctaccgaaaacccgtgaaataactcattttcggtaaattaaaaggattatgacatcttggtcataatccttaataattatcttaatgattagtcgcggcttgagccaccgaagatttggacgaagtagaggaacaagttaacgaagtccaagtataattgtaaggccccagtaacggccaaaccagtcgatgaaacctggtcaccatattgtaaatacatgttgcgcatccggttagcgtcccacatggataagccggcgaagatcaatacaccaatgtatgaaaagatgtaactaatcatggcactttttaagaacatattgaccagtgaagcgacaaacaacccgattaaagctgcaatcaagtgcgtcccaatacgtgaaatatcacgcttagtcgtcgtcccaatcaccgccatggtcgcaaatacagctccagctgcaacgaacgcaccggtgataacggcacccgtgtataaggacaaggtcactgacatttcaaccccaaagatgatggcaaagagcatcagtaaggtgaagctcatcgctggattgcgtgtcgcgttgacttgaatcccaccaatcatcacaaacatgctgacaatgaagatcatcaagaagatgaatgggtgttgtgaaaaggcggcattaatttgtgcttggaacgtggtcatcgctaagtaaacggtaaaggccgaaactaacacggcgattgtcataaacccatacattttagttaggaaactacggaggccaacttgtgtgttgatggtccgtggttgtgggtcattttgaaaattgttcataaaatccctctttcacctaaaaattgactactcgttactttttccgagttaagattaaaaattgagtttgtgcatcgttactaacgcggactgcgctagtaacaacaccacactagtttgtcaatcatttgcctatgactagccatctcaatcagtcacctcaactttcttaacttaagtctatcaaattagtcaaagaaggtaaaatagtttgtgcctgtgaatttaataagaatttcttatgtctaagtgaattccattcaatcattgtctttaatggattaccgctacattaggattttccggaatgggacaccataagcgtttataatagaacttcaatcggtaggactttttgcgggacatccggggaagattttttaggggcgggcggcgtcatacataactttctaaataagaagtcccacactagtattgacttgctagtgtgggacttcttattatttaatgtacaaagcattgattagttttagcatgttggaaactacaataaaacactaaatctagccattgtcttgttaattgttttctgaagcagaaataccctgcaaatatcgttgtcgcaatgcagctaccttaacctcaacaacttgattatgattaatccgtgcaaaagcttctgtttcactcattaaccgcttaatcaatttatccgaaagttgttgcttaacagcattctcggtcgctaagtatttcaatcttggtaagtaatacgtgacatgttcatctgagcaaagcgctaccccatcatctattagacgattacttgtgacgaaatcaccactaattgcgtaatactctgccgtataaaagattagggttaacagccgtaagtaatcatttgcatatcctgatgagccagcgtgctcgacatagtatcgtactctcctgaaataaaattgagctttctcaggctcagctaaccggccatacatgacacccagaccgacataagctagcggtgtgaaaattgtttggtgagccctatccaaatcatcaacgatttgcgagaaggaaaaacaaatatcactggctgttccattaatcaacgaacttagcatgccacataaatagtaatattgcatccgtgaaggtaccgcatcaatttgctcaactttcaggtctaccaatgattgcaggactgattgataatcttccatcatcagtcgtcgctcaatctcatcaagttgctgtcgaatttgggtcactgaattagcctggttttcacttagatcatcaactgtcaatcccagacgagcgcagagctgatttaaaattgctaatgctggtactcgcccacgccgttcaaacttacttaaagtcgcctgcgtacaaattccgtttgataatttgacttgtgaaatttttaaagcttttcgccgggcaataaacttttcaatatccatcgcacaccaccttgtctcacccgttagccatgaatgccaagggcaaccttagcaaaacgactcattttatcaattccccaagcaggttcccagaccaagtcaagttcacaattcttaacaccatccacactcataattgcttgattaatttgacttgccaataaatttcctaatgggcaccccatcgtcgtcaacgtcatcgttaccgtgcagctaccattatcgtctacgtcaacaccatagatcaaaccaaggttaaccatgtcaacgcccagttctggatcaatcacctgctctaacgacttcatgaccgcgtcttcaacgggtgagagggccttatcctcgccaagttcgtctgccattctgccacactcctgtctgtttaaaactgtttttaattataccattgttagaatatacgttaataatcctaatttataataaagtacgtcgccaatattaacgaaaaggcgaatcagcatgataaaaacactaaccgagatacaattttaaattactacaattatcaaccatcctagctggcacgattataatggctaacattcatcaacaatcatttaaccaaaaaactcgaatcgcaatctcgcatgccactcaagttttattttaacatcagcttaaccaatcccccttactacccgattgaaccttccatctcaaagctgattaaccggtttaattcaacagcatattccatcggtaattgcttcgtaaatggttctacgaatcccatgataatcatttcggttgccttagcttctgaaattcctcggctcatcaagtagtagagctgttcttctgagattttggacaccttagcttcgtgttccatcgcgacgttagcactgtcgatttcattatacggaatcgtgttggaagacgactggtcatccatgatgatcgtatcacactcaacatgcgctttggaaccgtctgaatgcttggcaaaacgcacggttccacggtaatcagtcgcaccaccagtcttagcgatggacttcgaaacaatcgaactggaggtattcttagcattatgaatcatccgagcaccagaatcttggtggatgccattgctggcaaccgcgatcgataacatggtcccgcgggcaccttccccattcaaataaacgcttgggtacttcatcgtaaccttcgaacctaaattcccatcgacccattccatcgtggcattttcggccgctgcagctcgcttagtttccaggctataaacattgtcagaccagttttgaatcgttgtataacggcagtaagcgttgggctcaacattgacttcaacaacggccgcgtgcaaactatctgaagaataattaggggccgtacacccttcgacatagtcgacactggcaccatcttccacgataatcaaagtccgctcaaactgacccgagttttcagcatttaaccggaaatatgactgaattggcgtcttcgtctggacacccttaggcacataaatgaaggacccacctgaccagactgccgcgtttaaagccgcaaacttgttatcggttggtttgacgagtttcccaaaccacttcttgaacagttctggataatcgtgaagcgccgtatcggtatcggtaaaaataatacctaacttttcaaaatctttacgcatattgtgataaacgacttcagattcatactgcgccgatgaaccggctaagtatttccgttcagcttcaggcacacctaaccggtcgaacgtccgcttcaagtcagctgggacttctttccagtcacggaactttttatcggtcatcttctgataatacagcatgtccttcaagtcgagtttcgtgagatccgggccaaacttaggcatcggcatctttaaatactcatgataggcatttaaccgataatccaacatccattgtggctcatgttttgccgcggaaatttcgcgcaccgtggcttccgttaatcctcgcccagttgaatatgctggtttgacatcgtcatgaaatccatattcataatcacggtcatttttgaccacgtcaggtacttcactcatacttctgattcctcctcattgccattttcagcaagcaatgcccgttgcaaagcccaccaagctagcgtggcacatttgattcgtgccggaaattgcataatattcgataaaattgcggcgtcttctaaggcatccatatcggcctgcgggtgttgcttgccaatcgccatatccgaaaatgtcttagccattgccaatgcctgttctttcgacttacccatcaccgcatccgtcatcatactggccgatgcttgactgatggtacagccctcacccgtaaatccaatatcttcgatttgatcatgcgcatccaattgaatagccaaattgatgacgtcgccacaagttggatttttcaacgtaatggcatgtgttgcgtttggcaacgcatttttatgatgcggatgatcaccatgatctaaaatcacttcgcgatataagccacttaatttagacagtcccatgttcgaaaaactcctttgttgcttggagtgacgttaataattgatcagcgtccgcttgtgtattgtaaatgtaaaaactagcccgtgcagttgctactaagccgagcgctgccatcaggggttgtgcacagtgatgacccgcgcgaacggcgacaccttccatatccaacgcggtagccgcgtcgtgcgggtgcaaaccgtcgatattaaaggcgatgacgcccgtatgatgttggggatcttggggaccgtagaccgtgacaccaggcattgcaatcaacttaggcaataagtaattgactaattgctgttcgtgttgctgaacttgatccataccgagttgcgtcaaataatcaaccgccgcgcccaagccgatcgcaccggcaatgttctgagtgcccgcttcaaacttccacggtagttccgcccaggtactgtcatcacggtgaacaaagccaatcatctcaccaccaaattgatacggtggcatcgtagctaataaattctcacgaccatatagaacgccaatgccggttggtcccagcattttatgccccgaaaatgcgtaaaaatcaacatcgagtgcctggacatcgaccggcatatgaggggctgcttgcgccccatccgcaatcatcagggcaccgtgttgatgcgccaatcgtgctaacgccttgattggattgaccgttcccaatacattactagcatgggtcactgaaacgatttttgttcgatccgtaatcttgttggcagcatcggccatgtccaattcaccagtcgccgttaactcaatatatttcaaggtggcgtgcttacgcaatgctaactgttgccacggaattaaattactatggtgctccataatggaaatgacgatctcatcacccgcttgaatattggcttcgccataagtactggcaatcagattgagactatccgtcgtccctttggtgaagacgatttcatccgtttttgcagcattgatgaaccgttgcaccttggcgcgcgcagcttcgtattgactagtggcccgctctgctaaggtgtgcacaccgcgatgaacattggcattatcgtgttgataaaagtgaacgagcgcatccacgacttggttggggcgctgagcagtcgccgcattatccaggtagacaagtcgttcatcattcacttgttggtttagaatgggaaaatctgaccgtaacgtctcaaaattggattccatcttcaagcttcctttcaatcgtgttcgttaagcgagtccggacagtcttcgatgggatcgcaccaatcacggtacttaagaagccccgaataaccaaccgttgggcctgtggtttatcaatcccgcgactcatcaaatagtacatttgattttgatcaatttgaccaacacttgctgcatgtccagctaacacgtcattttcatcgatcaatagaatcgggttcgcgtcaccatgggcatcatcagacatcatcaaaacccgattttcctgttcagcatgtgcaccggaggccccgtgaataatgtgaccgattccgttaaaaatcaggttagacttttccataatgaccccacgttgtacgatattgccgtcagtcttcttaccacggttagtgacccgcgtattaacgcagacatcctgggccttagtcgtcactgtgatgaccttggcatcggatttggcgccttcaccgatcagttccgagtcaaagtccccgaaagtgttaccattattcatcatcccgatagcccaatcgactttggctccccgactgattgcggcccgccgattcaaataagcagtcgtgttggccccgagttcatcgaacgctgaaaaatgcacttcactgtcagcccgtgccaaaatttctacaacacagttggcgatattatcgacgtcacccttcgttgtcaggtgctgagttactgcgaaatgactgtcttgttcagccacaatcaagacatgactaattaacggttgcactcgggtactatcctggatcgtggtgatctcgattggttctttgacagtaacccctttaggaacatagaggaagaccccggcgttcaaaaacgcggtatggtaactggtcaatcggtcctcgtcagttttgacgactttgtccataaaatgtttttcagttagttgcggatgttcgcgaaaggccgtgaacatatcggtcaaaatgacgccttgatcatctagttcatcaggcaaattgacggtcaccgttgtctgcccaacttgtacgatttggatatgaccagcttcggccgttacatcagttgctaaagttcgatccgaacgactgaactttagtggttggtcggtgggcgtcagtggccagtcgcgaatactaaagcgatcagctttgggaaccgctaggccttgcatcgcatctaaagccgctaaacggcgttcaacgagccagtgcggttcaccatgttcgttagcagccgcagctagcgttgttttgatagtttcataatcagcagttgcttccattactgccaccccctaatcttcgtcgtcaacaagtttgacatcaatgttcaaatcgtcacgtaaaccagcataaccttctttttcaagggtctttgctaagtcggcgttaccagtcttcacgattcgaccacccatcatcacgtgaacgacatcgggcacaatgtagtttaacagccgttgataatgcgtgataatcaatgagccgaaattatcgccccgcatcgaattaacacccttagaaaccacttgtaacgcatcgatatcaagcccggaatcaatttcgtccaataaggcgaatgatggcttgatcatcaataattgcaaaatttcgttacgcttcttttcaccaccggagaaaccttcgtttaggtaacgttccgtcatggattcgctcatattaagtagtgccaagttcttgtcgagttctttaagaaaggccatcactgagatttgatcatcggctggtcggcgtgcgttcattgctgcccgtaaaaattcagcgttggtgaccccttgaatttcagctggatactgcatgccgaggaagagtcccttacgtgcacgttcatcaactggcatgtttacgatactttcgccgttcaacaagatatcaccctgagtaacgtgataagccggttggcccataatagtttgtgataaagtggacttaccagtcccatttggtcccataatggcatgaatttcaccagttttcatagataaattgacgccttttaaaatctcacgagactttttttgctcatcatccgtcacttcaacgtgtaaatctttaacttccaaggttgccatttaaatcatcctccaacaattgaatttattacccaagccgttattccttccgtatataatgattagtcaacggcttcaacaaaaatagcgtagcatcggcctttttgtattctatacttagagtataaccgttttcatttcaaaagaaaataaggcttttccccatattaataaaagccctttcatgctatgatgtaggtataatatttttgatgaattattcactattggaatattcagaaaggactgatccttatgctaagtcaatccgttactaatacatcacaactacatattcaacaattcacaggtttggataatcagaccgttcaacgattgcacagcttagggctacatgtcggcagtccgctggccgttgtccgctactatccgtttcacggaccagtaattgttcagattgatcaacaacggattgggattcggtacaccgtatttcaaacgttgattggaggccattaagatgacgacggttgcattgctcggaaatcccaatactggtaagaccacgctattcaatgaactgacggataaatacgcgtacgtcggtaactggaccggcgtgaccgttgagaagaagatgggccggattcggcactctgaagttgaaatggtcgatttacccggagtctattcacttaatccaatcaccaaagatgaagcagtcgtcaccaactatctgctacataaccaccctgatctaattctgaacgtgaccaacgcgagtcagctcaagcgtaacttactactgtcgatcgaagtgttggaatttggcgcaccggtgattatcgcactcaacatgattgatgacctcaaacggacgggccattattatgattttgacacgctagctgaacaacttggctgtcagatcaaagcgactaacgcccgcaataaagaagggctgcatcagctacgcgaagacttattggcaggtccccatccggccgcgacaccgctcaaactcaactatcctttcatgattgagcaagccattcgtcaggctagccaacagctcatcaaaaaatttgatttgacagcagacttcgcacggtggctgacgattcaatttattaatcaaaataagccaattcgagcctacgcgaaacacatgggattgacaccactcactagtcaagccgcttattacgacgctcaaaaattcgacgagcagattttccaaacccgactagactttattgagcaaaccttagccagcgctagtcaaaacttggcaagcaccagccacgtcgagatgactgctaaaatcgacaagtgggtcaccaatccgttcttagggctacccgtcttcgtgggaatcttctacttgatgttcaaattatcctttgattgggtcggcacgcccctgtcagatttgttagatagcttcgtctccggaccactatccaccaccgtgagtcactggttgaccatggctggagccatcccggtcttgcgctcactgattgttaacggcctaattgcaggggtcggtggcgtgctcgtctttattccccaaatttttgtcttgtttgcctgtatttcaatcttggaagattcaggttacatggcacgagcagcactagttacggaccgcttgatgcagatgattggactcaacgggaaggcatttatccccctaattattggatttggatgcaacgtcactggtattatggccgcccggacaattgaacaacctaaagaacgcttaattacaacgctgatttccccatttatgagttgctccgcccgtctgccaatctacagcctatttgtggccgcttttttcccgaaaaatcaggccctaattgtcttgtcgatttactttcttggcattgcggtcgccctcggtatggctaaattttatcaactgattttcaacgtcgatgatagttccgtcttcatcgttgagttaccacagtatcatattccccgggctgacattatttggcgtggcacctgggataagggtaaagggttcatcaaaaaggcaggtactatcatttttgccggtacggtcttgatttggttactttcctcattcggcactagcggcttagtcagcgacatcgacaacagctttgccgcgacacttggcaaaacactattaccgctgttcgcgccactcggtgtgactgcttggcaagttatctcagccctctttactgggattctagccaaagaagtcatcagctctagtatgatggtaatgttccacagcgcaaatcaggccggcttgattgccatgatggggcgctttttcacaccgttatccgcatacgcgatgctcgtcttcatcttgctatatgtcccgtgcttcgccacgattgggaccatcaagtccgagactggatcgaccaagtgggctgtttacgccgtctgctcgagtttggtcattgcttacaccttggccttcgtcatttaccaagttggtcaattatttatctgaaaggagtttgattcacatggcattattcgttaatttcttaattatcgcactaattattggggctgctggctatcagatttatcgcgtggtcaaacgtgctaaaaagggcaaatgtgcggcctgcgactatgattgtgaagctaagaaaatgttaaacaaagcccagaagcaacaaaactaagactactgcacctgcctcactaaccacgtggttaatccttagaaatcatacacactaataaaacaccaatgacggagattctagtgaattatcctcattggtgctttatttatcgactgcataagttccattaaaacttgtaaggtcaaaataggtcgcacaactgttgtctagcaataatctaacatctctcatagggtttcatcttggatgctaacgccggtttacgctaaatcaatttaaagacggactaaaaaagcggccctgctggggccgcttttttaagaattatttcatttggtcttcataaattttttcgtacttttgaatgtcaccagcacccataaagacagcgacggcattgtggtaagccgttaaagcagacatgtcatcggtcgtgataatttcaccatcattgggtaacttagcagctaagtctttggaggaaacatcaccagatttttcacgggcagaactgaagatattggtcaaaaagacgtgatctgccttgcttaagctggctgcaaagccatccatcaatgctttcgtccgtgagaacgtatgtggttggaatacggccaagatttccttatccggatacttttggcgtgcagcatccaatgttgctttaatttctgatggatgatgtgcgtagtcgtcgatcatgaccatatcgccaacttgatgttctgagaaacgtcgtttaaccccactaaagtcgaggagttcccgccgaatttcgtccaagttcaccttttcaaagtaagaaaccgcaatgacagccgtgctgtttaagacattgtgttcaccaaacaatgggatttcaaattcccctaacgattcatcgtgatacttcacttcaaatgaagaccccttagtcgttcgtttgatattaaccgcttgaaagtcgtcacggtcattcgtcccgtaatagtaaattggggtatcaacatcgaggtgtcgtaaactttcatcgtcaccccaagcaaagatgcccttcttcacttgattgccaaattgttggaaagcggattgaacgtcagctaaatccttgtagtaatcaggatggtcaaagtcaacgttcgtcatgatggcataatcgggatggtaagcaacgaagtgccgccgatattcatccgcttcaaaaacgaagaaacgcgcgtcaggggtgcctttaccggtcccatcaccaatcaagtaactggtgggagcgatatgactcaaaacgtgggacaacaaaccagttgtcgacgtcttcccgtgagtcccggccacaccaatactcgtgaagccttccattaattttccaagaaattcatgatagcgataaacgggcaaccccatttcacgcgcctttttgatttcaggatggtcatcagtaaatgagttccccgcaatcactgtgaggccttcgcgaatgttatcttcggaaaacggtagcatcttaatgccagctgcagctagacctttttgcgtaaacgtatattgttcaatatctgagccttcaacttggtaacccttgtcatgtaaaatcaaggctagtgagctcatcccagagcccttgatcccaacaaaataataaaccgttgctttatccattatgctaataatctcccatattcacaattcatcaatcatgaggtgaatcgctttatttttaattatgaattggcttgtaatttagttaaatctgccgctgtgaaataaacatctcgtggtttggaacccttagctgctgaaacgtagccgcgactttccaaatcatcaataatattggccgcccgattatagccaatcgagaagtttcgttgcaacttcgatgtcgacatggtatcttcatcagcaatgtaagccaatgcttcaggcatcaagtcatcttcattgcgtgctgcttcctcgtgcttcactaggctgtctggttgaaattcatagtgcggtgctgcctgatcacggacaaactgagtgatactgtcgatctcactgtccacgaacgtcccctgcaaccgaatcggtgcgggttgaccgttgccaagatacaacatatcaccgcgtcccaacagacgttccgccccactcgcgtccagaatcgtccgcgaatcgatctggctggcaaccatgaaggccacccgcgttgggatattattcttgatcaaaccagtgaccacatcaacacttggccgctgagtcgcaactaataaatgaatccctgccgcacgggctttctgggtgattcgggcaatgtaatcctggacctcactagaagcaaccatcatcaaatcagctaattcgtcgattacaatcacgatatacggcatttttagagccggctcgtcatgttcgtcggccagtttgttgaattgctcaatgttccgggcaccaccagcggcaagtttatcataccggttgtccatttcatcaacgacccatttcagcgctgccgaagcggctttgggttctgaaatcacgggtgctaataaatgtggaatctcgttgtatggtgctagttctacggccttcggatcaattaacaacaatttaacttgttgtgggttcgctttgtacagaatcgaaaccaagatactattgatgaagactgattttccagaacccgtagcccccgcaatcaaaccgtgcggcatcttccgcaggtcagtgacttgtggttgcccgaataaatcgacaccgagtgcgaccgtcaatggtgacttactgtcgcggaatttgtcagaatctaaaacttcagacagcatcaccggccgcgatttcgcatttggaatttcaatcccaatcgtattacggccagggatcggcgcttcaattcgaatatcttttgcagccaaggccaatttcaaatcatcatttaagttggtaatcttgctgaccttgacgccacgagcaggttttacttggaactgagtcacagttggtccaatcgtccaatcgacaacgttggcattgacaccaaatgcgtccagagattcatctaacgcactggccttctgctcgatccaatcatccatctcagattcattggccacgatcggtgctttcaacagattcagcggtggcaaatgataagccgctaattctttatcctcaaggacgggggccgctgaaccgccactatgaactaactcaggttgtgaagccactgcagatgtctctgacaaagcgggactagttgtaactgcagaagtagccgcctgtgacggtgccatagtcacactagtcgcttccccactttcttgtgaagggaccgtggatgatgccacaacgctgactggcgtggccgttgctgacgtcacagcaggacttgtgctagttggccgcatgccaaccggttgataaggttcttcgttaacgtgtgaacgagtctgcgcagtacttgactgtggtgctgcagaagccgccgttgttggctgatccttaaataacgctaagtccgcctgggcatcgtgctcagcggtcataatatcccctaaggatagtcctagcccatgtgctgacttgggtgtcgcactagtcgcagcagattctattttatcatgatcagcagccgcattaacagttgcagcagattcagcaagcgcgggatcagttggttcaaacacttctgtcggccctgccgatactgccaaacttaccgcgctaggcgcatttatggcggccgccgacgctgctaaacttgggtcagtgggctcaaatacttccgtggggcctgccgatattgccgagcttaccgcgctaggcgcatttatggcggccgccgacgctgctaagcttgggtcagtgggctcaaatacttccgtggggcctaccgatattgccgaacttaccgcgctaggcgcatttatggcggctgccgacgctgctaaacttgggtcagtgggctcaaatacttccgtgggagccgtcactaccactgaatcatcggttttaggcgtattaattgccgcagccgacacagctaattcaggagtggtaggttcaaacacttccgttggtcgcacaaccgtcgccgaagctgcggacaccgtggaatcactgccggtctgtgacgtgttagccacgaccgtttgagcagccacgctcgatgctgcctgactagttaccgttgtcgggtcaacacttgaagccatcttccgttccgcttgactaagaactgccgaatcactcgggtgttcaacttgactcgtgtccgtcccactatcagaaagcggttgttgcaaatcaacagccggtaaatcattagctgctgcatccgcaaacaataagaaggtctcgggccgcttatgcaagctcgcttcaatttctaaataattacggtcatcgtgatcctgaatgataccgccatttgtcagcgccgcactaagctgggctggtacccgggatgggtgaaaagtcccatgggtgccaccgttaaagagggtcgcactagttgcagcactgctactcgaagtagttgcctgactcgtcacctgcttggcgctagtttgactggctggccgttttggcgccgcactaggtgcaccagcagtcgattgtggactagccgatgccgctacaggagttgattgactggccgctgaattattcacttgtggtttgttaaatcgatatttccggaaaaatgccgggccatcataatggttcattttcaatcatcctagtttttaatatctgcaaattaagcggtaaataacgtctgagcgcgtttgaaatcaaatggcgcacccactggctgataatcggcgggcaaaatcaaagcccctggccgttgtggcgcgttcggtaattgtaattctcggcctgaaacaatcatgccatcactctcaacgccccgtaattcgcccggccaaataattaagccactgggcatcattgcaccgaccttggcaacaacaaccacaatatccgcctgcatattaggtgaaccactcacgatttgaagtggttgatccaaaccaacattcgtcttggtaatctgtaaatgatcagacttcggatgtgcttcggctgattccacatagccgaccacaaacttagggtcagtgtctaaaactaattcaggttcaaaatcattggtttttaataaattatttaattgctcaacttgttcggccgttaagtgaacttgaccattggcatctaagtcgcctaacgtcttggaaacgtcaaagaaattatagcccaaggtttccccactgtcagcatcgctaatacgcgtcacattggcatgtgtttcaatcgtttgggtggccgcatctggtcgtaaaatggtgattaacgtgtcacctaattcggatggattataacttgtaattaacatgtgaaacccctttactctcattttagcgttcaacactatattatagcgtattttacttaaatcatactgattaattatgacttttctttgtattctcgtcaatcattggtatactaaatttaaataaaacatttcctagtcaagttagctgaaaggagacgcaacatcatgaataaacaattacaatatggcggcttgttagcggttgggatggctggtatcgccgggggcttttccgttggcggcctgttcaagcggttgcgccgccccacccctaaccaaattcttagccaagtcaagcgcgcgtttttgaaggaagcaccgattgaaggctcgtggattgaaatgaaaaaatccccattacaaaagttcgcattgcgcacggatgtctactatggcggcattacccgctatgaagatggtcagctggtacagtacgagtttttggccgatgccaatactggtagtattttagacatttaccggctttaataactcacaattgactatccgcatcaaaaatcaaaaatgagcttctggaattaaaattctggaagctcatttttgatgtttccgacaattacactcaattaaaaaacagcgatcgccgacgcgtttcgctgttctcattcagtctattttgttgggaaagttgcaataatcttataaattgggcccgccgcactgaacttctgttcatattcagtctcgacgttatcctcaggtgtggcaactgcatgcaagtctaaccaaacttgttcaaattgcatcccaaagttattcatgctcgttaatgaaaattcgaatagcccccggttatcagtcttaaattcgatctgaccgttgggttttaagacttcccggtaactgctcaaaaacgacttgtaggtcaaacgccgcttttcatgacgcgacttcggccacggatcagagaagttcagatataagcgatcaacttcatggggttcgaaaaaggcagtcaccgcttgaccgtccgcatgtgccaattgcaggttaggcaacggggcctcgactagctttttcaaaataatcgcaatcaccgaggtctgaatttcaatggcaacgtaatttatctcaggatgacgcttagccatttcaatgatgaactggccctttccactccccacttcaatctggagtggctggggtttggcaaaacggctttgccagcggccttttagctgagttggatcttcggtaataagttcgggatgggcggcaattaactttggcgcccacggtttatttctgacacgcatcttgattgactccttcttcatttgcttactcaacaaaatcgccgcgaattccatctgggactcgcggcgattttgttgctcgtcgttacacttcgtactgcgataattcttctaaaaagataatttcatggttcatctgatggtactgattccgataataattatctttgatattcaatagtaaattgatcttagcataccagaccactcgcgtccgtaaggcggtcgtcatagtctcaccgtattcactaagccactgttgccaatcacttaacgggacatattcgcatagtagcatactaatatctgacgccggatccgcaaatcgtgcggaatcccagtcaaccaagtacagttgttggcgatcagatagtaaccagttcttgtggttaagatcaccgtgacaaacgcgataatcagtggccggtaaagtgggtgcggttcctcttaattcatccagaacccgggccattaacggatggtgccgtaaatcatctggtaaatcttgtaagtattgctgaataaagtcttgtgggcggacactctgaccaccgacttttcttaacatccggtgaagcaactcggaattgtgcacacgtgccaataaatgcgccacttcaggcagccgcatttgttgcttcgttaaagtttgaccattcaaccactcttgggctgtcagcgtatccccgcttgagatacgcttcgtccagattaatcgcggggtaatttcttccatcgacagcgccgctaggaacggcgaggcgtttcgctttaagaacaatcgttggtgattttttttgcccatgaaagctttattcgtattcccatagatcgggtaaacgtcccagccatcatcaagttcgaaatccatcagccccactcctctcaaaatttatttaatgactcattattatttgacttaacaatcacattttatagacgaaagttgaatccgtcaagtcctttttaacccttgatacatcaaggttttaagctaatcttaattttaaataccaagtaactaagagatagatttcaatcacgttaatgatgagcaaaatcccaacttgagctaacggtgcgttgcttaaccagaacgcaactaaaaagattaatcccgtcaaacttaacacgtttcgcaataaccgctgaaagtttttcaaccgctgtttagttgccagcggataaatgtgcgtaaaaactatattatcgtattgcttgtaaaacggcaacaattgaaacccaatcaagtaaataaataaggcgtccaacgccatcgctaaccaaccgtgcccactaaagtacagtagcaccgcaccaataactgtcaaacgaaccactaacccgctaaattccgtgccgcgcaacatgccacgtgtatataggtagccaaacgcatgctgctggtccttaggtaaccaccgtagtaaccaatccaggtaccgacgacgtttgacactgccttgcaccattggtacatccgtaaataaattaaagaatcgataaatccctaacatacggttggcttcggctttgatgtcgtcacgccaagcaatcaccgtggtcgaccaaattcgttggtgcaaataacgttgtcccaccgcaatcgcgatggccattgcggcactcaaccacggcgtcactaatagtcccactgccaacgtgacgaacgcgccggcccagttcagggggcgcaaccaccgcttcatgcttggcttcacttgatagagatgcgtcacgctcagcgttaactgggcatcctttaacgccaactgggtgatgagtaacgccagcaacgaccagcccgtcatctgatcaacgatcatgagcaacggcacggtcaagccaacaaaaatcacttggactgcttgcgccaaccaccaactgtagcgccatgctttcacgaagtacgcatgcacatcccgttcacgtggtaacaggaaaacggtatcggccggttctaataacgttgcgatatgactgacacttaggcccgcccataataagagaccgagcacccagacgatccacgtctgctgagggccaagcgtcttgagccaattggagtaagccagcccgagtccgccgacaaaaaacatcaatgcaatgacaaagtgatcattgaacaccaatcttaggtagcgcaacatccgacgcagatgccgctgcaaccgcgtttgaaataactcattcatcacgggtcaccccggtcaatgaaagataaatatcgtttaacgactcacccgcatccggataattcgctttgatttcagcaaaagtcccctgtgtctgtacttcaccagcatgcaataatacaaacttatcacaagctttttcagccgtgtccaaaacgtgcgtcgacataaggacagcggctccctgtgctttgactgtcgcaatcaatgccaacaagtcgtgcaccgccaaaggatccagtcctaagaaaggctcatcaataatgaacaacttagcgttagtgatgaacgcacaaacaatcatgactttctgtttcattccctttgagaagttcgcggggaaccaatccaacttgttagccaatcggaaagttttcaataagtcatgagcccgttgccaagcctgttcttggtctaaaccatacgccagcatcgtcatttctagatgttcttttaatgttaactcttcatataagataggtgtttccggaatgtacgcaatttggcttttatagctttgaggatcttgtgctaatgtcacgccattgagcgcaattgatcctttcatgggcgtcaacaaaccgataatatgattaatggtcgttgacttaccggccccgttaagtccgatcaagcccactaattcaccgggctcaacttgaaaactaatatcttttaagacgggaatttgcgaatacccaccaactaagtgttgtaccgctaatgtcataacgttaacctctttctgtgttggtataagtgctcccattatagcatagccatcacgacaccctctatttggttggctcattgatccccgactttaccgaaacttcagtaatttgtcgtcaatcaagctacctagttttgattgccgcaacatcgatagtgtataatgaacccaactaataaataaagaaggttatcacatgacagcttttgaaccaaaactcgatgacgattgtatcttttgtaaaataattaagggcgatattccgagctataccgtttatgaagacgacatggtcaaagcctttcttgacatctcgcaaggtactcctggtcacaccttagtcgtaccgaagacgcacgttgctgatattttcggttacgatcgtgatcttgccagcatcgtgtttgcgcggattcctgaaatcgcccgcgctatcaaagcaactgacgagaatatcattggcatgaatatcgttaacaataatggtgcggtcgcttatcagtccgtcttccactcccattttcacctcatcccccgctacagcgataaagatgattttcggatgatctttaaggacaacgccaaaaaatatgacgaaaccgactacactcgcttacagaacgccattaaaactgaattagctaattaggaggtctcccatggcaaagtttattcgtaacagcctgatcggtctgggtctcagtgctgctacctacatgttgatcaatcagaaaacacctaaagcgctctacacagacatcaaaagttacgtgcaagacgttttagatgctgctgataacttacaagacgcacgtgaagagtttagcgatgcccagagcaatctcagtgttcaaatggcccacgctgcggaagtttttgatgacattcagactgaattggataaatttcaatttaagattgaaccccacgtaaccatcatgaaaaaacgtgcggatcacttacaagacactttagaccatttaaccaagacaaccgactgagcaagtaatcgtgaggtcgcattaggcccacgattcttttgtttgctatcttaacaagctgatttcgtttaaattcactgacgcattaggtagaatttatgaagaggctgtgaaatctctgaaaattttgtaaagatttccatatgcatgcagaagctttaatagatatggtatagtagtcgttgaagtctgctaacgcagaacgatttcaagaataggatgtgttttaggaatgaagaaatggctcattgcccttgctggtgtcttactaaccttcaccttagctggttgtggtagcaagaccgttgcatcaacttccggtggtaagattaccgaaagccaatattacagtagtatgaagggaacctcttcaggtaagcaagtcttgcaacaaatgatcctgaataaggtgctcgaaaaggattacggctcaaaagtttcgactaagcaagtgacgaagcaatataatacttacaagtcacaatatggtagttctttctcaaccgtcttatcgcaaaatggtttgacgaccaagaccttcaaggaacaattacgttctaacttattattgaaggaagccgttaaagacaaggtcaagattactgataaagctttgaagaagcaatggaagtcttacgaacctaaagtcacggttcaacatatcctagttgccaaatcagcaactgctgacaaagtcttagacgctttgaagaaggattctagccaagccaactttacgaagttagccaagaagtattcaactgatacaacgactaagaatgatggtggtaagttatcagcctttgataacactaacacgagctactcatctaaattcttaacggctgctttcaagctgaagaacggtgaatacacgacttccgctgttaagaccagcaacggttatgaaatcatccggatgatcaagaaccctggtaagggtaagatgtctgatcacaccgctgatttgaagaaacaaatttgggacaatgatatgagcgactccactgtcttacaaaacgttgtttctaaagtgcttaagggtgggaacgtttcaatcaaggataacgatttgaaggatatcttatcgtcatacctttcaacctcatcttcatcaagctctaactaattaaattaattaagccaccctgacgtttaacatgtcagggtggctttttttgcgtcgtactaagtctagcgcgtcaagcatgaattattattgcgctagaaatatacgtctctatttagcagatcaatcagctgacaagttaattatgattaatcatttcacgcacacttcgctagtcagtctaattattcaaagtcatcaataaaaatttatgattttattatcccctatcgccagcattggcgcaaatatcagtgctatcacaataaattcagaaccccctcggaacataataagctaagactaattgctaatcattaaatatatgcataaaaatagccgcaacctaatagattatgctagccttatagcaacgataaacgcaagacaatcttctggccaggagttgattatcgttaccaaacatttgttgatcaccgcaggcacggacaaccaaaaaggagcgatccatcatgaaaaaaacagtgcttaccgcgaccatgttgttaagcttactaggaatgcccgccgtcatggcaaccgccgattcaactgcgaacacaactactaatttggaattgacagaaaatactggaccaactatcccagtagatcccactaacccggccaatccacaagttccagaagatccagacaatccagctactggtaatactggtgctctaacattagacgtggctcctcgaactttctacttcggctccgttcaaacttatgccgccgaacacacttataaggccacgacgaccactaatggacaacaatatttacaggtcaccgataaccgtgggaccgatgaacagggttggaccgtaaccgtcgagcaagatcaagatttaaccgaaactagtggaagttcaccgcatgttttgaccggtaccaccatccacgtaccagccgggattgcacgtaatagtctggcaactgaccctacggcggtcgataccaacctgacgactacagctgccgatgttaccaatacgagtggtgccgtgaccgtttttaatacaacggccactaccggcgctggtaaaggcacttcggttaaagtttgggatccaagtgatgtcactttgacgattcccaaaaacacggccaaaccaggagcctacagcaacactttgacatggaccttgaccgctgctacccctagctaaccataaggagggattgccatgtttaaccgcttttgtcttagtacggggttagcgattttagggttaatggcaaccagtttgacggctctcggggcaacgactaatggtaccgtgacttttcaagatgatactagtgccacggccccagttgatcccactagtcccaacgtcccgttgacaaccaccgatccgaataatccggcaactaacaataccggaacattgaccctcgatgtagccccaaaaactatcgactttggtaccgtcactacgtccaacgcagccaaaacttacactgcaattggcaactacaatcaatatctacaagtctcggacaaacgcaccactgccaacggctggcaagtcaacgttaagcaagaccggacgttaactaacgctagtaataatcacgtgctgactggtgcggtgattcacctaccccaaggaactgcgcgtaattcgctaaacgagcccgcctcagtagccgattccaatttagttgttgcccccagtgtaagcgtcaccaccgctgaccaagtcgttttcagtgcccccaaccgggcgggtgttggtaaagccacttccacaaacacttggaacgcgggtgccgtgaccctttcaatccccaagctgacagcccaagtcggtaactacacgaacaacttagtttggacgttagtcgccgctaccactaactaggaggtaatcatgaaaaaattgatgtgcttattcggcgtaattggtggcttggttttcatgagttggacctcaccaagcgtccaggccaccgctaccaatgccgaagttcaatatagtgttaacaaaatcagtcccggccaagaagtcgatgctagcagtccgtttttcgaccttaaggccaaggcgggcaccactcgtaaaattcaggcgcgggtctataacccgactgaccaatcaattacggtcaagacccagctactcacgacatttacgaatgattcaggccaaatcgcttacacccaaacagccaaacgatacgatgccagcttaaaatatcgttttgatcaaattgcgactttggcagccggttccgataaagtcacggtccccgccaaaagtaaccgggtcgtcagcgccacaatcaacattcccaaaggattcgataccggtgtaatcttaggctcatggtacttcgaaaaaatggggcaaggcgcgaaaaaagcatccaagggcgtcaatattaaccaaaaatatagttatgcgttagcggttaaactgacggccaaagaaattgcacagcctaagttgactttggggacggtcactcccggattacgcaactatcgcaaagtcgtgctcgcgaccattcggaacccagaaccagcagtggtctcgcaattaaaactgaccactaaggtcacgagaaaaggcagttccaaggtactctatcagaacagtagcgacaacttgatcatggcccccaattcgaacttcacttaccccacttttttagacgatcaagtcatgcgggcgggtgattataccttatccgtcaccgcaacgactaacgactccaaatgggccaaaaaaacttggcattggtcccgggactttaagattacgactgaacaagcacgtcaaaataatcaaaaagccaagaatgacccggccgcccccatcagtatctggtggtacgtcctaatcgtcattgtaattgctggcttatccgccggaatcgtttatctaattatgaaacgacacaatcgcagaacctaaataagcagttaattttagattatcttctaacttggtactcaaacaaggaggttatcgttatggctaaattcaggcggctagttttactatcattaagccttggactagccctcgctggtggctgtcggagtcccgatgccctagcggctaccccaactgacactagtgtgacattgaccgactggcaagccgggacggacctgacaaacttccagcacccccgtccctatcaatatctagcggtgcccaacatcatcgccactgctaatcaacaggcttcgactcagacaccatcatccgcggcaatacgtccagataaatcagtgctaccacaaacgaatgaagcccgccaactgttagtctggttaggtctgttgacagctgtcttagccggttggctcgtgtggctcatgcaacgccgaagggagtgagcaatttgcaacgaccacgaagattaataacggcttggctcgggttactcgttctcttaatgagtctactcgttgtcaacggcggtgccatttatgcgacagcgaccaccacggccacaccaatcaaattcgaggaaccacccacggaattagtgattgggcaaccttttacacttcagttggccgtacaaggttcccaggaacaccaagtcatggtcgctattcctgaggccctcaccgttgaccaaactaaaacccggcaagccaacagagcgagcctcgctgagctggattttgatgctgacaaccggaaactaactttgacgccatctgatccgacagccagtaccacgttcgatttggtattgagtgccagtgaagcgaaaacctacaaagtgaccgcggaagcactgattactgggccagcattagcgaccactaccgcttcagctgtcgccagtagtgaaaaaccgacgacccacaccatgaccgctgaaccaataactttcaccgtggccgcgggctccgcagtcgactcacctcctgaagaagccggcactgaatcagcacgtgaggtcagcaatgatgccgaaagcacctcttcggccagtcaagacccgaccactgacgattcgtcagcaacagcaacacaagcggctaccacgaaacgtgatgacaacaatgccacaagcaaatcgtccgaacagtcgtctagtaccaccgcgacatcggacccgactgctgacaacgacactgctactagtcgcacagcgcaggctgattcggaagtagaacggacaccgaaagcgactgccaccaaagccgctaatgatatcacgaccgccgcaatcgtggtcaatccagatggtagcacgaccgtctcaacttacgatgatttaaaatcagcgtataccaataccgccgtcacgacgattaaattgggggccaacattacccacacgtcaacaagtgctacagaattaggcactcgtaccaccagcctgaccatcgacgggcaaaatcacagccttgatctcggcatcggtaacttcacattgggttccacaaccacggcccagacaatgacagtaaaaaacttcagtagtattcgtggcgcaattgcgagtggaacaagtagtggtggcgccgccggaatcattcaaagtgggaccgatggtggggctaatgctggtggagctcgttggacgattacagtgaccgatttaatcactaccagcgacgtttaccgcctcgtcaacgctcctggtaatcaagtcaatgtcagtggcgcagtcaccgcaacaaccgtcgctgaaaacatgattactggtggaatgacctttgccgccagcagtacctacatcggtcgcaaggcgaataacagtgccgccaacaaagctttcttcaacttcacggcaactagtacagttgggactggagaccgtaaagtcactattggtagcgctgctaatgttaacttgctaggtagcgcatcagacgcgactcggggtattttctatgaccagtatgatgccgtcacggtggataccaacgctatcctaaccgccaagatgtacggtaacgtctatcgggcagaaacagcaaacacgtttaccgccaacgttggcagtaaggtcacgtttgagaacttagccacaactagtagtaatgcgctctactacactaccccgttgattccgcttggcaacaacagtacgtttaccgtgacgggtggtgagttgtatatcactagtagtggctcagcccccatttttggtggctacatgtccggtttgagcgtcttgctagattctcctaaggcctacgacattaaaaatacgaactttgcaattctcgttcaaacggggtcaatcgtcgagacgaccattaaaagtttcaaaatcacgaacagtaacctgagtatgtggtcattgtccttattgaacctgttgagcgccagtgtgacctatcaagggatcaccgccatcgaacagaacggggtcctgattaccaacagcggtagcgtcttaccgggactactcaccttctcggctgcgcgccgaattgcgaacaccctctcactgccgactgtgcaattcagctcaccgtatacgagtgacttgaacgcccagctcgtcaccaatgccgacaagaaggtccgcgttcgcgttatcaccggttatacagaatcgaatggcacacaaacgccgatttacgccggaacgggcacggcaaccgtcaagttaacagatgatcaaggcgcaacgcaaagtggtacgactgacagcagcggttacgttaatttcacgttagatcattttccaacggccggcgcgactatgacagctcaagcaacgaccacctatacttcagatcctgtcaccataaccgtccaggataagacgccaccgacgccggtaaccgttaaagatggaaaaatcgttgccgaccaaaaaacgattgccagcggttccacgacgacggctggtaacacacttcgttacacggttaacgggacctccgcagctgatagcaacggcaatgccatcaccgcaaccgctgccagtgatgggagttggtcccttgcgatgccagccaccaaattaaaagctaatgacgtcattcagatttttgtgaaagatagtgcggggaacgagaatccggtcaccagtacaacttatcatgatgccacgtttgccgccgctacccaatacactgtcgcaccggcaatcggcccgacagcaccaactgagcccgagcaccctggtacgaccaataccagtgggagcgaaaacactgggaccggtaatacgggcgaacttcgtttagactacgcgcccagccaatttaactttggcagtgtcacaacaagtatgcagcctaaaacttacgccgcccagacaatcaacggtgtcgcgaaacagtggctccaagtttcggataatcggttagcaactcacggttggaccgtcaccgcccgccagaacagtccttttactagtactagtggcgcccaactcaccggcgcgaagttacacattcctgccgggcagacctataatgaacgcgctacgggccagctcaaaagctacgcggtcgatctcacaaccgccgaacaacccgtctttgcagccccagcaacggccaacgtggggaaagacctttcaaccaacgtctggcaacccacccaagttcaattgaccgttcctggcaacaccgcccaagcgggccaaacctataacacaaccgtaacttggacgctaacggctaacgtgacgaactaacaattaaatgtgccaaactgaggctcctcggccgtacaccttaagtactggccccaactctagcaattggaagcgcgacttcaaagcaccattagaccaccacaataattgtcgatttcatcacttaaatttgaccgtcgctggattgcccatcattattgatgacgcgacggttttttcctgtgagttcctaatgagctaatcatcagtaaccactagttttccatgtcatatactgagcttaagcaacacatcaacttaaaattgccaagtccgtataatgggcttggcaataatcaacctagttagtggctaaagtttgtaacgcctgtaaactagccgtactgagtacatccaccggctggcttaatcccggttgaaagaaaaagtcaccataggctaattgctcgagcgttgctcccatctggattgcgagcgaaacggtattgatgaccgccgttaattctgctgtagacattatttgtgcacctagtatccgatgagttttatcataaaacaacttaaaatgaacggtcgcattcaatcgagctggtgcggatgccaccaatcggggaaccgcgatgtaagttgctaacaccggttgttgcatacggacagctagttgcgtgtttaggcccgtagcagcaaagtaatatcccgccgcattaagcgcggacgttgcctgaacgccgggaaacacaattcgctgatccgttaacaagttatgcgctaataaccgaccggcatgactggccgcgctgcctaaagtgatccgctctttagtacccgtgggcgtaaaccgaactttagtcgcatcgccaatcgcgtaaatatctggaacacttgtttgaaaataatcatccgtctcaattaatccctcagaatctagcgccaaagttccccgtagccatgcagtattcggtcgattgccgactgcgacaaggactaagtcggcagcatactgaccacgattcgtttgtaccgctgtcacgtgtgttgaacctaatacggccgtcacccgctcttccatctttaattgcagcccattctcaacactcgctgcagctaaaatttgcgtaaattctgaatcaagattgtgactgaatggccgagcgttcacatcaataacagttacttgcttgccggtttgtttaaataaggctgcaaaattcatcccaatatagccgcctccaatcacgaccacgtttttaatggctgctgacttagcggccaattttaactcattgatgctggcacggttttgaatcgatcgaacaccagataattcggctccgggaatcggtaactggattggtaacgatccaacgctcaataccaatcgatcgtaatgatcagtctgtaattgcccccgttgattacgagcagtaatcgtgtgggtcgctggggtaattcttgtgaccgtcgtttggtcgaatagagtcacctgctgggacaaggccaaccgctctttttcagcatccgccggagcccaatccaaagccgtcgcgaattgcccgtgctcgtaccaatgaatctcattatccgtatttgctgctaataagccattgaccgtttcgcggccgccatgtgcagccccgacaataataatttttgccatattttccgcctctgattacttaaattattgttaacaacgctatttaagatacacgttgtctttaactacaacaatcgtttggctacggaaatcactattattaaggcacaaaaagcagtaaactgtttctaaaaccaattaggagatctttttgtgacccaactcaatcaacgtcgacgtggcaaccgactggaaaacgcgatttatgacaccacctataccctgcttagtcaatacggcctcgaccaggtcactttttcacgagtagccactgcggccgctaccagccgcagtgttctttatcgctactgggattcgacctttgacctcatctttcatactattattcatcaaatacaaaagactcccattgcacttacgaccacgccattagatactggcagtcttcgtaccgatctcattctgttagcgcaacgctttatccaacaaactagtacggggcccttccgctattttcggctattgtttgccacagccttgaacgcgcagaaccagcgcgatctcacgcagttagtgactcaaattgatcatgccaacttgaccttgatcgagccacttctgacgaatgcacaaaaccacggtgaacttcagatttggcctaaccaagccgcacaattagtattgtttcaacaattacggtactgcgacatcatcaaccaaccgatgaacactgatcagcaactcaccaatctcattgatcaagtcgttttgccggcattgcgagcaagtggcgttgctaaccggcattttcatcattaaagaacctcttcctcacaagtcaaataaagtctgatttcctagcccatactgcgttggaaatcagactttatttttaatattgaaccagcgtcacccttaactagccaaaaccaggcgacgcccccctttacccgtctaacaaattgtaatctggcgcttattgacgataatctgcccttcagccgccaattgtttaaactgacgactcagggtttcgggagtaatccccaaaatattcgccaattccttcttcttcaacggcaattcaaattcgatttgtccggattcaacggcacaatcgcgcaaatacgccatcaaacgcgctttagcatccagcaaatctcgtcgcaattgattcttctcagcttcaatcaattggttcccaaaattattgatcattgctaatgataaactggctgattcacctaataatcgctgaaaatcatcatattgaatggaacagacccacgcatcactcgtggcttgaataaatccctgattctcatgcggtgcaaatagccagtgttgtccgacgacatcaccactacgcaacaactcaataattttctccttaccattagcagctaaggcataaattttagccattccctcatctaaaatgagcatgccttcctgatggtcgagtggctgacgaatcaactgccctttttgataaaatttccggtgatgggtcaccgtgattaatttggcttttaccgctggcgctagcggtgaaaataatggtgaacgactcacacaatccatttttgaatgcataatttctccttttcttgatctatgtcaatttttatatgattagactagcatatactgaccatataatgaagaactggaggaattattcatgactaaaaaatacgttgctaacatcgtcccgctgaacgccgaaggaatcggtactgccccacacggcacagcgactttcactgaaactggtaaccaattacacgtcaccattgaaatgttcgataccccggccaacacgcaacactgggaacatttccacggctttccagatggcaaagcggcacagattgctactatggcccaagatgtcaatcacgacggctttgtagacttgcctgaaactgaacctgtttctgggacgacgatggtcccatttgataatgcgccccatcatatggacgtaccaaatgataattacccagttgccgacgcgcagggccacttcgcttatgaaatcgatgtgcccttaggcgacctacaggctaagttcaaagaagtcttcggtaccgatgacttagaactagacaagcgggtcatttatattcacggcgtcccacaagacttagccctacctgcatcagtcgctggtgaagtgggcatgtatgatgctcacgtaaccctaccaattgcagttggtaagattgaggttacggaagactaggcaattattacttaaactcacaaccaaaaactaagaccgcttaccactatcagttagtagtggtaagcggccttaattttttatgaaatcagcaaaagcaaatcctttattggaattgcacgatatcattactatgttagactatttttaaccaacattaaattgaggtgttttcaatgaccaacgaacaacgagttattcatattggcaaattacaagtttaatccgaacaagcccggaatctttcaatggcagtctgttgatgatgtatttttaatggtcgttgattaattagttcaagtgctgctaggatctcatcagtcgtacttggctaaaattgggtctttttcgggaagaaccagcgtaccgtctattaaaatatattgaacctcgctcccatggtgaatatggatggcaacaaataaactttgatctgataatcctgttaaggcctgataattggcaaactctttacacatgatcaaacgtaatggattaaacttgggaccgaaggccccctaaacttgccaaaggcggtgtgttagagcctagccgttcattaggggctttgatgcccatagaagtcgggtcttacgttctacgaatgtaaccagacattgatcgtgactcacttcgactagaaagcaccgtatctacttcccaatgaccaaagctaaccgttgattaacagttgttggccgttgttcgatggaagtcccacttgaaatttcccacgattttcgctactcgcgtgctggcggacattcgaattgggtagatcagtcaattgaaggggagccagccacgattaagcccattataaattgacgcagtgctcaagttataagcggccgcaatggtttctggtgacaggttaatcgtaatgtaagtaattggtaattaaagtcgctaatactgctgccgtcagcatcgaacgcgaccgccatccgccttttgcgatctgcatcttgctgagctaattctggatcataggtttaacccggtccaactcatagctaatcgtagctttggcgacgcctaaggcgtcagccattacttgaagatttattcccctccattgccgttgtgctgtgcgccacgttgaaaaaaaaaaacaaacccgggatagaaacgtgataaagtagatgtacccaaagtaatcactccctatattggttggaattagctactaccattgtaagtgattgctttgggctttttaatttctgttcggattaattatagaatttgcctattattaaaacaactcctgctttaatgacgattcttcaattaattcaagactgtcatttaaaacaaggcgcattggcggctggtagcatccgtaatactgtttggcaagtactcagcgggcagccagtgatgttcaacagtgatattgacgtcgtcttttttgaccctgagcgaccagccagcgatgatttaaaaatctatcagcaacttactgataaagccccacaataccaatggcaaataaaaaatgaggtctatatggcacattataattttgataaggatcccgaattcacttccgttaccgatgcaattggtcactttgtcgaagttccaacttgtattggcgcctttttagacgaaaatcaaatcaagctaatcgccccatacggtgtagacgatttgataaactttcgctgttccccaatcccctactatcgccaggatgccaagcacatggcaatctatcagcagcgaatggcacagaagcagtggcatcaacaatggcccaagttacaaattgatggtatttgaaatattatgcatacccttaatttacgtcatttaggccaagtcagcttttaatattgcccgctgcacgtccaacgtttctaacaaactgaccgcacagtcagcacccttattgccactcttaaagccagcgcgatccatagcttgttcaatggtatccgtggttaaaacgccgaacattatgggcgtatcggttgccaaactgacggtcgcaatccccgtcgtcacgccacgacaaacatagtcaaagtgcgcggttgcaccccgaatgactgccccaagtgcaatcacgccatcatagcgcttggttgtaatcattttttgaaccgtcagtggaatctcaaaagctcccggtacccaggccacgtcaatatcggtttcattgaccccatgctgtaccaaactttcttgtgccccagttaaaagctgctgcgttacaaacgcattgaaacgcgccacgacaatcccaatcttaagcccgttgccattaattttgccgttaaaagttgtcattcgtgtccctccgttagtgtgagttgatgatgaaatcgatcacgttttgtttttaagtaagcttgatcgtactgattggctggtatttctaaggggacccgttcaacaacatcaatccccgctgcacgtaactgctcaaccttgtcaagattattagtcagcaaacgaacccgtgtaatccccatttggcgtagaattaatgccgcaatatcataccggcgctcatccggttgaaagcccaactgcacgttcgcatcatacgtatcaaccccgtgttcttgaagtgcgtaagctgctagtttgttagccaagccaatgccgcgaccctcttgccgtaaatagacgaaaacaccgcgctgagcttgactgatcttttggagtgcggcgtgtaattgatcaccacagtcacaccgccgcgatcctaaaacatcgcccgtaaagcattcagagtgtaaccgcactaacactggttcatcgccactgatatcaccagcttgcagtgccactggcaacgccgtatgaccgggggcttcgaaaccagtcatcgtgaacttaccatccttggtcggtaagttgacactcggggtcgttgtcagctgggcggcacccgtttgaatcacgtaggtggtaatatcttcaatggtgattagcggtaattgtaagccctctgccaaagctttgagatcacggcgccgcgccattaagccatttttcttgataacttcacaaatataggccgcgggggtcacacctgctaattgtgctaacgtgacggccgcttcagtatgaccacgccgcgctaacaatccaccagtccgcgcaatcaatggaaaaacgtgcccgggatgatagaaatcagcggcctgactattgggattggctaacgcttgaatcgtggtcgcccgatcagctgccgagattcccgtggacgtcgtatggtgatccgttgagactgtaaatgccgttccaaacgcatcgtgttcactagtcatcggtgtcaaatgtagtcgcgtggcgatacttggcgccatcggaacacagagtagcccccgcgctgatgtaatcatccgattcactgtcgcagtggttgctttagcggctaggccaaccatgtctccttccgcttcacgcgtctcatcatccgcaacaataatcaattcgccccgttttaatgcggccaaggccgctgctacctttttcattgtatccatcttaatgactcccctctaatgctaattgccgggccaagtacttgcccagaatatccgtttctacattcaccagcgttccaacttgtaacttagacaaggtcgtcaccgcttgtgaatgcggaattaaatcgacttcaaacgttgtctccgtgaccgctacgaccgtcaaactaaccccatcaactgccaccgagcctttagtgactactagtgcgcgatattctgacggtaaactgatcaacagacgcaacgcgtgcgcatcagattgtcgctgcatcacttgaccacagtaatcgatgtgcccctgaacaatgtgcccatctaagtgcgcgttcacttgtaacgcacgttctaggttcaccaatgaaccgaccacaaggatctttaagttcgttcgacgcaccgtttcaggcatcaccactacactgaaagcatccgcttgtcgggtcgttaccgttaaacaaatgccgttcaccgctatactgtcaccaatcttaagactcggtgtcatcagcgacggtgcggtaatcgtaagggtcatttccaaccattgttggtgcacttggctgacacggcccttggtttgaataattccagaaaacatttacttaacttcctttcgaacggcccgtagccggatattcgtccctaaacaagttaccgttggttgttcaaatgtcaacggtgtcatcgcagcggccccggtaacggctggcaaacccgtcccaccaatcatcattggtgcgatgtagctgacccattcgtcaatcaattcagccgcaacaaattcagcttgcagatgagccccaccttcaactaagagtgactgccagccttgttcgacacatagttgactgattgcagcgggtgtccagttgccaatcaggacgtgtacattgggactgtttcgaagttggtcgtcactagccgcagcctgacgacaaagtaaccaggttggtgcctgaccgtcctgaacaagccggtggtttaacgccacggtactcgtattcaacaccaccaatcgaaccggtggctgcaccattgccgtcagtcggacggttaattgtggatcatcaatcgttagcgtccgttcaccaatcagaatcgcttgaaactgtgaccgtaagcactgactatcgatataactagcatgattggaaaccagcgtccgagtcggcgtttcagtattaattttgccatcaagcgttatcgccgtttttagggtgatccatggtcgctgctgcacataaaaatgattgtagtgggggttcaacgcgcgaactttgtccgttaaacagcccgtcaccacatcaactccgtggttcaaaagatactgacgtcccttaccacccacgattggatggggatctaattgaccaatcacgacttgccgaattccagccgcgacgattcgcgcactacacggcggcgtcttcccatagtgtgaacaaggttccagtgtgacaaataacgtggccccacgcgcctgttctggtgtgacctgccgcagcacatccacctcagcatggtcaccgccaaaataatgatgataaccttgagctaacacgtggccgtctttgactaataccgcaccgacctggggattttggtacgtcgccacccccgccaatttggcttgatcgatagccatttgcataaaatcagttaacattggttcacctccaacaagataaaaaaacacccaattatcaaatcatcgataatcgggtgtgaagtgttcgccaaatagatttcaccagtaggatccagctaaataaacctacttaaaggttgccaatagccactactgcctagtaaaattcaagcaataattttcttctcccatccagactatactgtcggtcccagacttgcactgggtccaccgctcacgcgggtcacggacttcaacttacgttgttaccgtcggtcgggaattgcaccctgccccgaagaaatcgtattcagttttcaccttttataaaaacactttcttaatcaattgtcaatcaccccttttagtttaacctcgtgaactgctgtgttaaactgctagcaaactttataaaaatgataatgactaacactaattcttaacttttttcagaaaattgttcgcttttcttaactagttttcaagtttcagtacggtacaatgaaatcattcataatatcggagttgaataaaatgtggcctaattatcaaacaagccgctggcaagtggcagtgacagctggattactgtcccttgctatcatggggattgtcttcgcaatttgggggatcacgcccttcggtaaccataacttattaattagtgatatgggtggccaatacttatcatttttcaccgcgtatcggcatgccattttaacgcatagttttcaattatattcattttcacagtcattaggcggtaacgcactacccacgattgcttactatctattaagcccatttaacattttgatgttgttgtttccggcggccaatttgccaaccggacttagtctactcatcatgttaaaaatcagcttgattgcggtcactatgacggcttttttacaaacgcattttcaaacaaagcggtggtcgactgccatttttggtgttgctttcagcctctctggcttcgttgccctcaactattttacgatcatgtggttggatacattaatttggttaccactggtcattcaaggactcgaccacttaattgcaactagtcatcccgagcgctttttcggctggttatgggtcagtatcgtcaccaattactacttaggctatatgacttgcctatttgtgatttactattttatttatcaactatttgaacgcaaacgccctcaggacagtctttggcaaactgttcgtcatcaattttcgttaattcggcacgtcgtggtcaccatgctactcagtgggttaagcacgatgtttgtcctgatccccactggtttaggcatgctgaccacggctaaatctgcggtcaaattatcgagctacttaccggtcccacaattcggtttagctgttttgagtcaatttggcttaggtgccgccaattttacgactcggctcgtacacgcaccaaccgtcttcagcagtagtctggtcgtcttgctggccctaagtttctgggtgcagcccaacttgactaaagctcacaaatggcatagcttcggactattacttgcactcttcttgagtatgaacattcgtaccttagatacgatttggcacatgtttcaaacgcccgctggctttccataccgcaatgcttttttctttagctttgtcttgatcatgatcgcttttgaagcctggttagcaggcccccggcggatcgccttgcgctggcaatggttgttaccgacactcatggtcagtgcgctgatattaggctggtttgcccaacgaactgctaagcaccccttaacaacttcaacgctggcgctcagcttagtcgctgtcatcttaaccgcaattgccttattcgcaacggcgaagcggtggcaaacgctcagcttggcaggtatcgtcgccttagaattagggactaacagtaccctcatgatggcgaagtcaccactagggaatcaggctaaatttgtaactgcctatcgaaccgaataccgccaaatgcaagccgtcaacgatcctgatggtcaattatatcgcgttgaaaatcaaaatacgctaatcaatcaggcctacaattatgatagcaagtatcgtaattacaacgacccgatgttatttaactttcacgatattacctactacagttcaacttttgcgaaccaaacacgtctcatgttgaagtcacttgggctattttctaaaaacgcccggcgtgtcagttcagaaggcctaaatccggtcactgatttactcttagatgtaaaatacgctgtgcaattaaacgccgtgggtcaagcgacaacgcggctccgtagtcaaaacgggttagggtttgccgtgccaatagcatttagacagttaaagcttcgtcagaatagtgccattatcaatcaagaacgcctcttacaaagtttgcggccatcgaaacgcgcctattttggcaatgccacgacgctctcagatcacgtcgtccaagattcacaggccaaacgctatccgtatttgcatacagttaaattaaggatgacacgcaccgggacgctgtattataacgacacgactcgtcaaacaaagtacaccacgatgcgggtcaacggtcacttagtcccgactaagttcaatgccaacggtgagttagtgctccgatcgctaggttattttgacaaaggcgctgtcatcacgttaacggtcaaacgtacccaaccaacgcttggcacccatgtccacatcgccagcctggatcaagcccggttcaaccaagtcaaacagcaactgctatccacgcgctttacaccgacttaccacgtctcgggcattcataccgtggtcagtggtcaagtcacca

SEQ ID NO: 740 - DNA, 57158 bp, Unknown
  Metagenome-assembled genome
ccatgggcacgaataccgcatcgattctcgtttcggcaggagcgatcacggtgctcctcattcctatcgcgacaagtcgtgcgtgtcggtgccgagtccgatgtcttttccggtggcatgaggtggcagcagagaagctgccgatccagaaggtctggaagaagcaccgggcactccttcaggccgacgagaagcgctttgccgcagctgtcgaggagcagaaagagcacggcaccagctcgactccttcgaatatctcgtgaccggcgctctccgacaagagctggaaggaagatcctcaggagaaaacggaatagaaggccagataggccagatgaggaagggagcggcagtgccggccgctcccttctgcttttcacgctctctgctatccgatccggtgcacccgggcaggatcgaagcggccaggacctgtgggagagagggggctttgcgggatgtccgaccgcaacgattgcgaaggggcaaggcctgcatcgtcggggattcccaggacctgtgcagtggcatgcacgcgctcctccatggggtagatgccctgccagacagcaccacagccgagctctgccgcctcgacgaggatgttctcgattgcggcggccatatcctgctctgccatatcggggcaggggaggccttctgtcttcaggcagggaacgattgcaagcgcagcatgaggcaaggcttcgcatacggggaggcagaagcgagcgcctcgagctggaccttgccttcgacaaccagaattccagggctctggttcatggcagaaggtgctgccatggcagcccgcagaagccgctccacctgctcctcggactgcttcgtctgtgtatgccctcacgctcgtgcgggcaaataccggatcctgtgttccatgtcggtcctttctcgtgaatcttctgactcttcccgaagctggcgctgatatgcgtagtgaaagtccgaaagggtgtctaggaccaatagccgctcgtgcatgctgctctaaatgcgatagagttgcccgaagcaggatccctctctgctgcggcaggcgcgccggtttgggttttttccccgccaggccgtcgctctcgaaggcgatcttagatccgacatgagatgggcatccagatcttcggcgctcgcgcagaggccgttcgaggtgacggaggaaggggacacgcttcctctccctatgcaaggcatgtcgtcgagcagtcagagctcctcgatagcccctacctcggcatacctctggcgtgcgcgtgtctctcttcggttcggcgtcctcgcccagcactatgccttttgtcgtcaatatgcctcgccgagctcgtgcgcgaatatgggcagaccggctatgagttctccctagcgcgagggaacgacgttcggcacgattgtggtgatgtgcgcctgcaagcgctcggagccgcgtgctcttccgcaacagctcaatcaaccgcgaagtgtcactgatgtattgcgcgatgccgacctcaggtttctgtccgctcttcgaggcgaaggagcatgtgttcctcgcaaagggacatcctctcgcaggaacgtacgagcgtgaagctgaagatctggcacccctatcccaaggctctcctatgaccagggccatgaagaattccttcttccttctccgaggagccctatccgacaaggcgtggacacggcaatcgtccgtgacagaccggcgacctcttccatctcctgatcggcctcgatggctaacacgagctcgtcgggcatcctttcggccgacctcaacggtaaacggatatcgtggcggtgccgctcgagcccgccggcacgatggaagatcggctatatcaagccaggtccaccgtccgctctcggctcttgccaagactatctcgaccatctcgaatcgtatggtccggcgctacttctcgattcggatatatacagcgcgaagcgatggtaacgatagataactcgtagtttcatatggcaccgattgattggatgatgcatccatcgacagcagaccctgatggaggcaaaaccatgatcattgcatatgacaggaagcccgcaccgcttcgacggtcccgtcggaagcttccgcggccagagaggctcccacgacgcgactatgcctggaaggcaggaaagatctccgcggaagagctcaaggcatagaagacgagtgcatcgagaccttgtcgcgatgagaagagcaggcctcggcgtgatcacagacgcggcagagttccgccgcgagacctggcatctgacttcatgtgggcctttgaacggcaatccccacaagcctgccgattcaggccttccgttccacgacgaggcccaagcaaagatcgacgatacgtaccttgtgggcaagatcgcactacaagcaacccatccctttctcgaccacttcccgctttcgtccattgcgcttgaggacgagcgtacgcgttgcaaagcttactaattcggcaccttcccagttcctggagccagttcgcgtgccgttcaacaaggagaacgacgacaggtctatgccaagccatgcagagcttgcagacgatatcgtgccgggatatcttaatcttcacgcaggacctctatgccgcatgctgccgcaatctccagccttgatgactgcgcgtggggcatggtcgtggatccgcatgcagggcagttcttcgccgtcgatgagtcgggccctcgagcaggtaaggaagcgctcctcggaggtgaacaaccgcgtgctcgctgccggtcccgaagaccttacggtcaatactcatctcccccccccttgccgtggcaacgttccattcgacctgggcctgcgaggcggctacgaacggctgggccgacttcctcttcgcgagaatgtttgctggcttcttcctcgagtacgacgatgcccgctcccggcagcttcgagccgcttgcaggtgccgaagacaagcttgtcgtgcttggcctcgtgacggacgagcgcccgactcgagaccgcggagaccgtgatgcacgctcctgagcagcagtatgtgccctggagtcgactctgcctctctcaaccccgtgcggctttgcctcctgccgactgcggcaacaagctcaccgaggaagagcagtgggcaaggttgccctcgtgcgctcattgcaaagaggtctggggctaggatcttccatgcacaagcggcgcgcccgcatccttatgggtgcagggcgccgctgccttgtctctaggaagtctgcctagtcgagctcggcgaagtccggctcgaaagtgtcggcgcagctgaaggtatgggcgccttcgtcgtaggcgaatgtgaagatggagcagttcttgatgccgggatggtactggacgacgttcgcgtccttccaggctcggatgaagttcgcgcagggctgctccgtggctcacggccagagcgcaggcacatccgggcgggacatgatctcttcgtctgccttccgcatgcgtgcgacgagcgtctcctgggagtccccgccatacgcccgaagaaatcgccgaagggagggcaggattcagggaaattgtcttccccctcgtaggcgccgaatttccattccttgaggccacggaggcgctcgtagggagggatcctccattggcctcgaggcagacatcccggcgtattcgttcggcacgctcgcatcgtgctcgagaagaagtggtcggggtaaaatctgctagtcgattggcttgcggatagattgtttgaatctgctattctcttgctcttgagagccatggaatgggcccagagcgagagtgggcctacgaacaaaccgtgtggaagtgggtgcgcgagggcaagatgccggtgcccgtcgggaagacggcgaccggcgtctggctcttgcatgacccgaagtacgagcttggttccacgcctgcctcagcggtccaccgtctgctacgcccgcgttagctcatctaccagaagtccgaacctcgtgaggcaggggccgtcgcctgaggctttgccgtctccatgggagtgggggatcccgaggttgtgtcagagatcgggagcggcatgagcgacaaaggcgcaagtcagcctcctcctcgcggaccccacctccaccaccatcatcgtgagcacaggaccgcctcgcccgcatgaacgcgggcctcgtcgagagcgcgctcgcggcccagggacgcgcgtcgcgtcgtggtggacgacacggagctcgacgacgaccttgtcgcgacatgccgaggtgctcacttccttctttgcgcgaggctctacgggagacgtgtccgccacaccgcgccgagagcgccctcgaggcgggcgagccgctgatgattgaggccgtcaaggtcgcgctcgaccccacgcccaggcaggcccgcatgctcctgtcgcatgcggtgccgccggttcgcatacaacgcaggccttgcccacttcaagggcagctaacaaaggaaaggcccgacctcgcacacacgcgctcaggcgctggtggaatgccagcaaggacgtccttgccccctggtgggccgagaactccaaggaggcctactcctacggcctcgagtgcctgtcccgcgcgctcaggtccttcctcgactcaaagcgcggcaacgcaaagggaaggccgtcggctttcccaagttcaagagaaggcaagctcaacgcctaaattcgcctacacgaccggctcgttcggcctcatcgacggcgaccccaaggccctcagacttccgaggatagggcgcgtccactgcatggaggacgtggcacgccgggtcggaggtgcccatgtgacgcgaatgaccgtttcctgtcatgccggtcgctggtttgcctccctcacggtcgacgggcggacggtgacctcttcccagcccaaggccccccgcggtggggtggacccggcgtctcccacctcgccacgctttccgacggcacagtcgtcgagaacccgaagcattaccagaagagcctgagacgcctgcgcaaggcacagcgcggcctctcgcgcaggcagaagggtcagggcgtcgcgccagggcaaggcaccgcgtccagcgcatccagccgcgtcgtccagccagcgcccgcacagcccctcgagaagctcacgaccccttgccaggagctactcggaatctcgatcgaggacctcaacgtcgcgggaatggtggcaagccacaacctcgcccaggccgtcgaggacgcctcgttcggcgagttccgccgcgagctcgagtacaagtgcgtacgcacgggcaccaccatacacgtcatagaccgttggtacccaagcagcaagacatgctcgggatcggggcagtgaaagccaagctgcccctctccgtgcgcacgtaccgctgtgaggcctgcggtctcgtcatcgaccgcgacctgaacgccgcatcaacatcatggtcgccgggagtgccccgtagaccctaaacgcgcgtggaggggacgtgagaccggaggaccccatggtcccgaggcagagcccagcgaagcgcgaaccgggcgggcgcacaacaagcgccgcaaggcccggagctggcggaggcaaccccgccatgcagaagctgaacaaactagtttgcaacggcgtatgccaagctccctgaaatgacgtccgcgatgcgtgcctggcatggccgcgttcggtcagaggcgagtcgcaccagccctggttcttgtggcggacattgaagagcgtctcgccgtccgcatgagatagagcgccttcatggtctgtctttctcctggaatgggtcctggcctgagcatagcaggagccgatgctctgtctgagcacacggctttcaggtgcgcttctgcctgcgttcagcctggttttcatctctcttcaaatgtctcgaagcattgtgcgctgtctgcattgtcgatgcccacaagcgtccaggcaggcgtgacacgcgtttaatctaggccaacagcaatcgagctttatggaatggaaggggtccgtcatgaagcgaccgagcagcctcgaaggcgtgtctgtgcagacaggacgggagcgttccggaaagatctcgcacgagttggtgcattcgcgctgacaggcgtcctcgtcttctcgtctgcgcctctgtatgcctttgcagaaggggcacctgccgcgccgcggacagtcccagcggcgagccgctgacaggcggcgctggcggcatggccagggtgccggaccgatacgatggcctacgactacacagggacctttccggcatcctcgtcgctgacggcacggagagcgactcgaccagcacgaccgtgagcacggcgaaggatgtgaatgctgcgcttgtccagaatggcggcacgctcacgcttgatgctgcgacgctccagaagtcgggtgacgataggatggagactcctgcaacttctacgcgcggtgaactcgatcctgcttgctgtgggcgaaaatcgactgccacggtgcagagaagcacgctttcgactacctccgaggggtcgaacggcatctttgcaaccgatggtgcgaccgtccttgcctatcaggatgagatcgcgacgacggcaggcaactcgcgcggtctcgatgctacctatggaggtaagatcctggcgtcggagctctcgatctcgaccgaaggcgaccattgcgccgcgcttgcaacagaccgcggcggcggcacggtctcggtcacggcctcagatctttcgacggcaggctccggctcgcctctgctctattcgacgggcgatgtcgaggtctcgggcgtcacgggaaccgccaccggctcgcagatctccggcatggaaggcctcaacacgatcctcatcgaggactcggacctcacgagcacgatgacgaagcgacagcgtccgaccccatggcagatgccgtgatcatctaccagtcgacctcaggcgatgcggagagcacgacaggcgagacagccaagtttcaggcagcggactcgacgctctcgagctcgatccagtcaggctccttcttctatctgacgaacacgtcggccgatatcgtgctttcgaacacgacgctcgattttgactccgacgcggcggcgctgctgacagcagagggcaacagctcgaacaattggggcagtgccggctcgaatggtgcgacggtgcgcttcaccgctatcggcgagacgctttccggaaagatctctgcagacacgatcagctcggctgacgtctatctgaccgccggcacgacatggaccggtgcggcggacatcgagcagagctctgccggctcgacatccgagacgcctctttcggtttcagtcgatgggacctcttcctgggccgtgacagcagactcgacggtcccgaacctcacgcttgcagatggtgccaccgtttggacagctcgggaaacgacgtccagatcgtcgccttccggcaaggtgctcagatccggcacctctgatgtgatcgtgacggtcgaagggagctatggcacgcctacgatgcctcctctgctggcacgcttgcgacgagcacggcagacgcagcgccttcgatgaggcattcggtaccgatacatccttcacgatgggcgaaggcgtcactcaggcaagcgataccgaagacacatcggcttcttccgaggcgcttctgatgccgcatccagcacggaagcacgcaggcaagcccttcgtggtgggacagcatcgtgaacttcttcaagagcatcttcggataggaaagactgcacggccctgaggcttctctcggggccgtgctgctgtgcgaggatgccgatccaagcacgcgcacgagcgcctcggcatcctcttctttcgtgggcccggcttgtcgcgagacacacaatcgtgtgatgctcgtctggcttctcccggaagcttgcaagcgccacttcgccgagacgctttgcctgggagttggagaggatggggaagacctggttcttctcggtcggatgggcaagcgcgatgccggcatcttcgaaggcatgagagatctcgtgcgcgtgggcgatggcaggcctgccgatgcgctcatagagcccatcctcgaagaaggcctcgaattggacgccgagcagacgtcccttggcaaggcgggctccttgctgcttcacgaacgtgaagaagtgggggacaagctcaggctcgggaagacaagcgcctcgccgaagagcgcaccgcacttcgtgccgccgataaagaaggcatcggtgagatgtgcggggtcttcgagcgtgtcatcgttttccggtgcgagcaaggcataggcaaggctgcgccgtcgcagcaagatcttgagatggcgggcatctgcgaccgaacgcagcgcctcgagccctgccttcgtatagatgaggccatactcgtctggctgggagatgcagatgagtgccggctggaccatgtggccacggttgccatccttctcccagagcctcatgaattcgtcgacatcccctgctgcaagcttgccgtcgtggccggggattgcgggcaccttgtggtcgcctgcttcgatagcgcctgcctcatgcacggcgatgcgtcccgaggtggcgcagatgacgccctcccaggcagggcacagatcgcgacctcgttcgtctgcgtgccgccgacgaggaagaagacctcggcggagggcgccttgcaggcactctttatgagctgctgcgcatggaggctgtgctcgtcgagtccatagcctgcgctcttctcgtggttcgttgccacgagacggtccatgatggcatcggcaaagccctcgagataatcggaagagaaatcgagcttctcctttgcggcctgcgatgcttcccgctcatgggtgcgctctgcatagatcgtgtggcgggcggtctggaaggcggcaatacggagatggaccagtggctcaacagccacgcggccgatctctgcttctgcgcaaagctggcgcggggcacctgctacgactggaaggcactctatagggatgagatggtcatgtggctgccgaaggaccatcctctggcaggggctgcgagctatccgatccggaatctcgagcacgaggcattcatccatgcgcttgccgaccatgatacggaccaggaccggctgatccgcgaggaggcgctccacatcgaggaccgctatgagacgaccgatggcttcacgacctgcagcatggtctaggcaggactcggcgtgagcttcaaccagcgtctcatcagcaggaaatgggcgggagccgtggcagaggtccccttcgaggagccacactatatctctctcggcatcgctgtgccatctcttgctgaagcctctcctgcagcacagcgcttcattgcctgcatcgagggcctcatgccgcgcctggcagcccttgcccaagctcctgcctgagctttctgcatagccaaggacccttctctccgttcgcggagccttacagaaagctgcacatggataagccgctttcctgcgagaatggcaggtgcctcatggtggggcatgctgcattgcgaatatgtgaggcatgccgtatcatttgacagatgcaggcagagcgtctgagggggcctcagcctgcatgcatagccaggaaggcgtctggccatccatatgcagggagcgattcctgccacgagagaggggttctgctgtgggatatgtgctcacgcgggatggattcgacgagctcatagcgaagctcggcgaaacctatcgcatctatgctccggtgctcaagaagggagagggacgcttcaccgacgtcgatgtcgtgcgctatgacttcgtggcgtccggctccgagatggagctcgagaagaagaccgactatccggcgaaggaggtcctgagcccgctgtcagagacgctcttctacttcacggaggattccgtcaaggaagcagatatcgatccgcgcgacgtgatcgtgttcctgcgtgcctgcgacctccacggcgtccgtcgtctcgaccagatctatctcgacaacggtccctcgaaggactacttctacaagcgcatccgcgaccacgtgcactttgccctcatcggctgcacgaagagctttgcaagctgcttctgcgtcgatatgggcacgaatgtggcgcccgtgggctggatgttctcagtcgaggaagcaggggacaagatcctttccgctgtggcagacaaggacctggaccccatcttcgctgcctgcgcagagaaggaagaggacgtcacaccggcttccgtcacggagaacgaggtgcatgtgacacgccccgagacggtgccgaatgcgatctatcgctccgacatgtggaacgagtacacggaccgctgcatcgagtgcggccgctgcacgatcgcctgcccgacctgctcctgctacacgatgcaggatgtgttctatacagagaacggccgtgtcggcgagaggcgccgtgtgcaggcaagctgcatgatcgacggctactccgatgtcgcaggcggcggctcctacagaaagaccgctggcgagcgcatgcgcttcaaggtgcttcacaaggtctatgacttcaggcgccgcttcggctacgacatgtgtgtcggctgcggtcgctgcgacgatatctgcccggaatacatcagctttgctgcctgcgtgaacaagctcaatgctgcctgcgaagcctacgagaaggaagaggaggcgaaggagaatgcctagccagacggtgacgttcgacgctgtgaacgatgcggccgtgaacccctacatccccttctcgtcagagatcctcgatgtgatcaagcacacgaagaaggaatacacgttcaggatggcatatgagggagaggtgcgcccgggccagttcttcgaggtatccgtcccgaagttcggcgaggcaccgatctctgtctccggcatcgtgcctggcaagtccatcgacctcacgatccgccgtgtcggcagggtcacgaacgaggtcttcgagaactatgtgggccagaagctcttcctgcgcgggcccttcggcaatggcttcgatgtaagcctctaccagacaggcgaggtcgtcgtcgttgccggcggcaccggcgtctctccggtccgtggcgtcatcgactctcttgcctcctctcccgacccagagaacaagtacgtgatcgtcggcttcaagagcccggacgatatgcttttccgtgacgaccttgcccgctgggacaaggcgctgaacctgacgctcacagtcgacggggcgcctgaaggctacgagggcaatatcggccttgtcacgaagtacatcccggacctgcctctcaaggacccgaagacagcccaggccgtcgtcgtcggtcctcctcccatgatgcgcttctcgatcaagggcttgcttgagctcggctttgccgaggagaacatctgggtcagccaggaaaggcgcatgtgctgtggccttggcaagtgcggacactgccgcatcggcgagcactatgtctgcctcgatggcccggtcttcaactataccgtgtccaaggacatgctggattaggagggaacgcatgattcaggacgtgaatgtcaaggcgctcaagaagaatgccttccgctacagcaaggtccgcggcgagacggcaagccgtatccgcatcccgggcggcctcgtctcggcaaagagcatggccaggattgtggagattgccgaggagttcggagatggccagatcttcctgacgaacaggcagggcgtcgagattcccggcatcaagctcgaagacatgccgaaggtgaacgagaagctccaggccatcatcgaggacacgaagatcaatcaggaggatacggcagacggctatctggcttccggcacgaggaacatcgttgcctgcccgggaaagaggctctgccccttcggctgctatgacacgacggccttcgcccagcgcatggaccaggcaatcttcccgaacaaccgccatgtgaaggtcgccttcaccggctgctcgaacgactgtgcccatgtcgccctcaacgacttcggcatcatcggcatgaccgagccgcagtacgacccggcacgctgcatcggctgcggccagtgcgtcaagtggtgccagcgcaggtcggtctctgccctcgagatggtgaatggcaaggtcgtgcgcaacgaagaccgctgcatcggctgtggcgtctgcgtcgtctactgcccgacccgcgcctggacgaggagccccgagcactacttccgcctcaagatcttcggccgcaccggcaagcagaatccgcgcatggcagaggattggctgagatgggtggacgaggagtccatcttgaagatcgtgaagaacacctatgcctacatcgaggagtacatcaacccgaatgcgccggaaggaaaggagcatatcggctacatcgtggaccgcacgggcttcgacgagttcgtgaaatgggcgctcaaggatgtggagcttcccgagaagtgccagcaggcacaccgtgtctactggggcggcacgcactacgaccgcgacaacgagctcagatagcttcagctctctccggcatgcagggaggcgcggagccgtgcggcgcctcccttttccgattcttcgctgttcctggcggcagtgcatgggaccgccagccatgccgagcaatccgctggcttttcatgcggcaccgaggggctgatgccgcgcacggctccgctgcctatgccttctgcgcggcagatctttcctgcggtatcgccacagcggatgcctgcttttgctcgaagcccatgcttgcctgcagaaacgagccatctgccctcttcctggacaggctcgggcatctggatgagcttttgcccgaaggctcagggagctcttcgaaggcctgccttctcaggggaatcaagactgacggctttgatctgggactcggccctcaatcccatgagcgcatagatgaaggaagacatctcaatgatgcgcatgtccagcggttttgcatatgcggatatgctgagagcttcttcgctatcgatggggcagcagctgcctttggtctacgattgcccttgtccggttccgccatggaaaagggaggcccgatggctgcaggcaggattcgcgccttcgtgcgcaggctcaaggacaggatcgcgctcaacaggaagacgttcatcctctattcggtcctgcgtgcgctggtgctcgtgaccctcatccgctgcatcatgacggcgaggtgggaaggcgttgcgatatcggtccttgtgctcgtcctcttcctgatgccggcacttctcgaggaccgggcacatgtcgacatcccgccgctcttccagaacatcatctacatcttcatctttgcggccgagatcctgggcgagatcgaccactactatgtcctgattcctggctgggatacggtgctccataccctgaacgggttcctctgcgcagcggtcggcttctcgcttgtcgacctcctgaaccgctcgagcgacaagatcagcctgtctccgatctacgtgacgcttgttgccttctgcttctcgatgaccataggcgtgctctgggagttcgtcgaattctcgttcgattccttcctcggcatggacatgcagaaggacacgatcgtgtcctctatatcctcggtcgccctggaccccacggatacgggcacccgcatccatgtggacgatatcgtggataccgccatcacatgcgcctcgggcgaggtcgtgcatgtcgcaggctacctcgatataggccttatcgacacgatgaaggacctgctcgtgaactttgctggcgccatggccttctccgtcgtcggctatgagcacctgaagcgcggcgagcagggcagctgggcagacgggcttcgggtggtgccggtaacgcctcaggaggaagaggagacagatgtccttctcgagcatatggccgtgaagcgcaacgagcgcaggctgaagcggaagtagcctgtccgccatccattcctgtcggggccggcagctgccaagcgcgaaaggctgcgcggaaagatggagcagcccgggcttagggctcggagccgaaatgcttgggcattgccggcggcacggaaggaagcgttcccgcaatgcgcgaagccctggaaaaagagttcgcggcgcttgaggaagagaagggcgcatgtcttctctctgcagcagagtccgggagccgtaccgggcgattcgcttcgtgctgtgcgcgcttcgtccctatgcatgagcatgcgtggcttctgaggcgcgagaaggggcgtgacgccagcgaatggaagtcggcgagacgctcgatgtctcgggctgggagatggcaaggtccctgaggcctgtgcgtgtcttgaatgcctccgttcttgtatggcttgcatctcccatcgtctgtcggaagccccctgtcttcgcaggcatgaaggagctggcagcaggggaccaccacccacgtgtcggcatctgccattgtctggatatgcgatatggaacctccgcgcagggctcgtgcacccgaagaggcacttccctgctacacacccgatactggcagcacgcttgattctggaacagggcacggttcatccgtgcccttcgaagacctttttgcagcagagcttgagcgcgagctcctgcctcatgcggacaggcttctgaaagagaagattaagagcgcactgtgtgtccgaggatcctgagaccgatggctggtgtgagcggtcctgctccgacatccaggacagggaaaagctcgccccaaggcggaaaggctttcatgggagtgcattgacgagatgctcctgcatgcgccggaggaagtgcctgaaagccagaccccggccgggacacttgcctgaattctgtgccgccgcgctcggtgctgggggcaatgagtgcctgggcttcggccaagcgcggcttctgctccccgtcaggcatgtgggattgccgtcttgcgcgaagcgaagagcagcctcgctgcatcttccgggtacccttcggagggctctggctctccgtcttctcgacagcatgtgccagacccgcacgaaagctgcggcagccacgacagcaggaagcagctgccagcagctttcatggacggagcgaaagaggctggaaggcaggtggcggcagaaaacgagaggctgatccgatgcagccaccgagtctcccaaggccggtacagcagatacgtgctgcaccttcgccttgctggcgaaggtgctgccgcttctggctaggccgtctgggcgcgggagcgtgtcctgccctggaccatgccgacaaggaggaaggcaaggccgaagagggcacagatcgcgatgtcggccagaaggggagcagcagccgcaggcgtggcatctgccattgcgctggcaccctctattgcaagtgcagaccaatacgagggcgtgaaatgggcaagcgcgatgatggagtcgggcagaagcgagagccctgtccacccgccgcccaggaaggagaagagcatgccgaggatgttcgcaatcgcgttggaagcattctcggagcagccgagctggcccatgaggaagcctgcggcggccgagacgagcgaataggcaagcagggcggcaccgacgattgccatctgcacaggcgagtccgcgatggcagtgcgtcccaggatggcagcctggaggccgaagttccatgcccaggcaatgagtgcgactgcggtgcaggcagcgaagagcgcaaggcttcttgcgcgtgacggttcgggagaggcaagccttctcatcttcaccggagccctgttgacctcggccatgaggacagcgatgcagacggtcacgctcgcaaagatgggataggcggaaaactctgctgcaaccacgatggacgacggcaggggagatgccttctgagcgatgagggaggtcgcggcgctctccttccaggcgctgtccgctgcgtccgcaatgccttctgcatctttgcctagcacagccgcatttccgtagagtgcatttgcatagctcgtgacttcgaggtcgaggagcctgccgcggccggactgataggagatgtaggtctcgagcggaggggcatctgttccggctgcggcggcatccatgagggcatctccccagccttcgggaatgacgagaaggtaggagaccgtattgcgggccagggcatcctggatggcgagtttgtcatccgggatgtccatcgcatcgttgccgtcctttgcatgcgcagcaagcgcttcggagagccgggagccatcgcggtcgatcacagcgacgctcacggaggcgggacggaattctgccatatccggcgaggcgctgccgagaccggagatgatgccgacagaggagatgaggatgaggtagattacgatatagatcttgtgggcagacaggatcttgaggtaggtcttaaaggtgctcatgagagatcctcctcatacgcaaggatgccagggcgaaaaatgccagcgccatgaagacaagggctgtgcagcgcgcctggaaggcatcgagcgtgtcatagtagagcagggcatagaagcagttcgtcatttcccagagcggatttgcataggcgaggaaaggcgccgaggattcgacgaggtcggcaagcgactgcgaggccgggccatagagccccgtgaagagcgaaagcaggcatacgatgcctgacaccatgccgctctccatggcagggatcgtgccgaggagggcacctgctgcacaggccacgagcgccgagaggaagatggcaagaaggacaagcgctgcattgtcgccgaaatcgacctcggcgacgaagcgcatgaagaggaaggctgcgaacatgcaggcaaactcgcagagccaggtgccgagaagcgtgccagaagcatgcgccagcggggcgtcgaggcaagcgtcgtacgtgcgccgacaggtcctgcctcgggcagaagccttctcaccgattgcatggcagctgaggcaccaagtcctgctgccatagcaagaagggcaaagtagtagcggacatccggggcgggtgccgtcttcgtggcggtgaggcgtaccgtgctcacagctcctgcttggaaagcagcgagcgctgcccctgactgcacaagatcggggcgcagcgctgtgatgtgttcgatcgcagagcgcatcctcacgtaggtatcgagcacttcggtcagcaccgaggcggggaggtttccatgctcggtcaggctcgaggcgctcacatgcagctcgggcactccgtcatctgagacggtgaggtaggcatcgattcttcctgcatcggctgcgtcctttgcttcctcttctgtctcgaaagagacgaggtctgtgatgtggctctccgagtctgtgtcggagatggaagcgagcgtcgcatcgaggcctgctgccttctcgaagttctcgtcgtgcacgacgccgagcgtggagccgaccatcgcatagacatcgtcgaatcctgagaacatgcccatgaagatgcaggtcaggatgatcggaaaggcaagggcccagacaaggagcgccttgtcgcgcacaagcgcaaggacacaggtcttgaagcttgcaagcatggctgcctccttactcctcgtcgcggagctctcgtccgcagatctcgaggaagacatcgttcagggtcggcggctccgagagcacgcggccgtaggcgatgtgcgctccggcaagcacggcgaggatgtcttggagattgtgggcgccagcggcgcactggacgcggagcatgccgtctgccatctctgcgcggcgcacaagttcaagcgagcgcagatgctcgagcgttgcctcgtccatgctgccgacctcgatcgagatcttctcgccggtgccgatcatgcccttgagctcgtctgcacttccgcttgcgaccgagcgtccatggtccatgatcatgatgcggctgcagaggcgctctacctcttccatgtagtgcgaggtgtagatcacggtcgcgccttcgtggttcaggcgctcgatgcctgagaggatggactcgcggctctggggatccacggccacggtcggctcgtcgaggatgatgagatcgggcctgtgcgcgatgccgcaggcgatgttgaggcgacggagcagtcctcctgagagcttcttcgggcggaacttctcgaatttctcgagtcctacgaaggcgatagcgtcatccaccagtgcacggcgctgcgtccggtctggcacatagagcgcgcagaagctgtccacgttctcgcgtaccgtgagctcgtcgaagacggcaacctcctggggcacgactccgatgtggcgcttgaggtcgtagcttgtgggcttcatgggcttgccgaagagttcgatcttgccatggtcataggtcagaagctgcaggatgcagttgatggttgtcgtcttgccggagccgttgggacccaagagtccgaacatctcgccgggcatgatatcgagggagagatggtctacggcaacgagctcgccgtagcgcttcacgaggttgtcgatgtggacgacgggtgtgcgggattccatggtggactcctttccaaggctgctgatgcaattctcagggaacggcgtgcctttcggaagtgacctccgtcaccgcctgcaccatgacatttgtcatggtctgcccatgctttcctccggctgagaaggatgagggcatctgcgcctatgcttgtcccatggagagagcggctgacaagacactgatgggatttgcctgcctggcgctggctgcgctggcgggcgaggtgcccgttcagacagtgagtgcactgctattggcaatctgcgcaagcgctgcctacgagctcatctgcggacgtgtgcctagggctgcatcttgcctgagctgtgcatcctgcattcttctggccagcgtgcctggggccggagcggcacttccgctccttgcctatgacctgccacgctcgggatggaagtggcttgcttgggcgggtcctgcctgtgccctcatcccctgggcggcgggcagagcgtctctggatgaagccttccttcttcttgcaatcactgttctggccgaagcgctctcctggcgctgcgggcaggaacttgcgcttggagagaagctgcacgagacacaggacgatctctccgacaaggtgcttgcgctcagaggcaagatgcaggagctcgaggatgcccgtgtctcggagacgcaggcagcagcgcttgccgagcgcacgcgcattgcaagagagatccacgattcggtagggcatatgctcacgcgtctcgtgcttgaggtcgaagcgctgaaggtcgtgcacagagacgatgcggcagcgacaggggagctcgaagagctctcaggcggtctcaacgaagcgctgagctcgatgcgcacgagcgtgcatgcgctcgatgattcggcacacgatcttgggacagagctcaaccggctcggcagggaaagcggcatcgccgaggtcgcggtcgactgcaggatagaggagctgccgccccgggaggtcttccgctgctttgtggcggtgacgcgggaggcgctcacgaatgcagcacggcatgcccgggcggggcgcgcttctgtgcatgtggccgagatgccaggcatctggcagctcaggattgccaatgatggagcggtgcccgaagaggcgtccgagctcgaagagcagggcatgggccttcgcagcatgcgtgagcgcgtcgagagcttgggcggcacatttgccgtcacagccgacggaaagcagttctcggtctttgcatccgtcccccgaaggaggcaggcgtgaggattatcgtcgtggatgatgacagaatcgtcgtgaggtcgcttgcaacgattctgggtgcagaacccgatatcgacgtcgtcggtaccggcacgagcggggaagaggcagtatccctcttctctcagctccatccagacattgccctcctcgatatccagatgccgggaaaggatgggctctttgcagcagagcggatgctcgaagaagatccttctgcgcggatcgtcttcctcacgacgttttcggacgacgactatatcgtgcaggccttgaagctcggtgcctgtggctaccttatcaagcaggatgtggctacgattgctcccgccctgcgctccgtgatggcagggcagagcgtgctcgagggggaggtgctggcgcgtgctgcctcgctttcgcagaagcgggcaccgtcagagcacgatctttctgccttttcctgccttacagacagggagcgcgaagtggttgcaggcatcgcagacggcctgagcaatgcagagattgccgccgcgctctgcatgagcgaaggtaccgtgcgcaaccacatctcgtcgattctggcaaagctggggctcaggagccggacgcagatagcggtcttctactaccgccactgagggccggaattcattcctgccgtggcagtcgggtatcgtaggaagagatctcttctgcgataggagtgccatgcctctttcgattgtccgccaggacatcacccatatgaaggtcgatgcaatcgtcaatgctgccaatgagcgcctcatcatgggtggcggtgtctgtggtgccatcttccgtgcagccggtgaagagcagatgaaggctgcctgtgcaaagatcggccatgttgcatgcggcagtgctgtcgcgacaccgggctttgcgctccaggcgcgctgggtcatccatacggcagggccccggtgggatgcgatgccgggcccggactcacggaagcggcagcttctttcgggctgctacatgaactcgctcgatctggcagggaagctcggtgccacctcgatcgccttcccgctgatctcgtctggcatcttcggctgccccaagagccttgccctcgagattgccacagaggctatccgcagctggctcacagaagaggccaaagccaagccggatgctcccgatatggatgtctatctctgcgtcttcggccatgacgcgacgaaggcagcgcggaagctcgaccgcgacctcgaggaatacatcggcgagacctatgtcgacgaggcaatgcagaaggacaggcgcagccgcaggcgcgagctcgagctcctcgacgaagacacctcctctggaggggcgccgctctctgcctcggcacccatgccaagcgctcacgaggcaactcctgaagacgagctcgacgatcttctccgcaatctcgacgcctcgtttccggagaccctgctctccatgatcgatgcgaggggcatgacggatgctgaggtctataaccgtgcgaatctcacgaggcagtacttcagcaagctccggtcgggcaagatccatcccagcaagcgggtcgtgcttgcgcttgccgtagcgctcgggctcgatctcgatcagacagagctcctgctggggcgtgccggctactcgcttgcgcacaacagcaagttcgatgtgattgtcgagttctatatcgggcatggcatctgcgatatcgacgagatcaactatgcgctcttcaagcatgaccagcagctcttgggtgtcgcctgaagccctcttcctggatgtcgcctcaaaggctacctgcagagaggctccctctcctagactcgtggcagcacgaggtcagggtggccaaggccaccagagaggagcagatatgtctcagcatgcagacttccagaagaggaatgggtccggcacacatgatgtcctgaagcttcatgggaaggtgcagcaagggctcacggagcttgtctttgtcgtcgacgagtcgggctccatgtacgatctggcgaaggatacggttggcggcttcaactccatgctcaggaagaaccgggaggcggatggcaaggcgaacgtctctgccgtgttcttcagcgatggcacgcgtgtcgcgcttgaccgtgtccccatcgagcacgtgcgtccgctgaataggtgtgactacgagccaggcggctccacggcactgctcgatgcgctcggtggcgccatctcccatacggcaaaggtccagagctatcagccagagggctttcgtgctgagcatgtcgtctttgtcgtaatcaccgatggctacgagaatgcaagccaccgctatacctatgcacgcgtgaagcggatgatcgagggctatcagcgccagggatgggagttcgtattcctcggcgcaaatatcgatgccgccgcagaagcagaccgtctcggcatcgcttcggaccatgcagcgcagtatgctgcagatggcgccggtgtggaccttgcctatcaggcgatggcagaagcgacggttgccgtgcgcgcctgcggctgcatgccagaaggctggaacgagcgtgtgaatgccgatgcaaggaagcgcgtctagagccccggaagccagcattccagaagggacattcccgccgccggatctggcacaggggtgctctgctgaacgcatggtgcatagctatcaagtgtcttatgctatgaccagcaatctcatcgggtccttgaagctgcagactatgggcggaaagccctgaatgctggatacagcatgctgcgcagaagacagagattagatacgtctccgtatacgtgaaacgtatagcgacctgcagaatcagcagacaggatcttgtccccttgcccttgcactgaaatcgtcaggaagaggatccctgcatccctgaagaggcgcggcggggatgccggaggggacttcggctccgggaccaggaggggcacaaagatggagaggcgggtactgggaaagagtggcatcgaggtatcgcatctgggcatgggctgcatgggactcacgcacgcaagcggagacctgatgtcggatatcgaggctgagcgtgtcgtgcgcgaagcctatgagatgggctatacgttcttcgatacggccgagtgctatgtcgggatgcgtcccgatggcacggaggcccacaacgaggatgtcgtgggagcagcgcttgcgccggtccgtgacagcgtggtcatcgcctcgaagttcggcgcccagcatgctgccgaccgcacgcttgtgatggattcttcgcctgcgaccatcaggaagtctgccgagggaagcctcaggcgccttcagaccgaccatatcgatctctgctgccagcaccgcatcgatcccaaggtcgagcctgaggcggtcgcttccaccatggccgatctcatgaaggaaggcaagatccgtgcctggggcatctcggaggcaaacgaagagtatctgtgccacgccgatgcggtctgcccggttgctgctgtcgagaaccgccactcgatcatggcaggatggcatgagccgctcttcccggtgctcgaggagctcgatgtggcgcttgtcgccttctcgctgttggcaaacggattcctgacaggcgcctactcgttgaagaccaagttcgaaggtgcacaggactaccgtctcggcatgccccagtacaccgaggaaggcgagaggcgtgcacgtccgctgatcgagctcgtcacccagctcgccgagaagcatcatgcagccgatgtccagacatcgcttgcctggatgctctgcaagaagccctggatcgtgccgattccgggcagccgcaagccggagcgcctgcgccagttcaacggaacggacaatccggaagagcagcacaggattgcagaggagctcctgggagatatgggagcacgtgctgtccttatggctcccttccgctgtacatacggcgtgcacatcagcctcggcgacgatgtcctcgtgaacatgaactgcacattcctcgattcgaatctcataacgataggggaccgcaccctcatcgctcccgatgtgaagatctgctgcggcgagcacaatatggacgcgtcgaagcgtttcgggacgagggcggatgggacgaggtatctgatcatgacgacccgtccggtcacgataggcaaggactgctggatcggcggcaatgcgacaatccttccaggcgtgacgatcggcgacaacgtcgtcgtcgcagcgggggctgtcgtcacaaagggcctcccaggcaataccgtctgcggcggcgtgccggcgcgggtgctgagagagctgtagagtcgaaactataggctgtgccaagcgagatggaggagacgcaatggctatcacggtcaatttgaggtatacgggaaaagacggcagcgcaaagaagttcgccgaggagatggaagcgtcgggtacggtcgatgccatccgtgctgaagcgggcaatctccgctatgagtactgggtctccttcgacgacccggagaccgtccttctgatcgactcctgggagaaccaggcggcaatcgatgcccaccatgcatcgccgatgatgaagacgattgcagagctgcgcgacaagtacgacctgcacatgacgttcgagcgctatgtctcggatgaggcgggcatgcctgagagcgaccagaagttcatcagaaaatagcagagcattcgcaatgtcttgacctgcgccgtccagagctgcatctgggcggcgctttctgttggaggctatggtgggaaagctcccaatgcggctcaactcgacatgaaggcaaccttccatagtctcattcgtcccatttcggcaatctcgcctttgagctgccttttcggtgcaagaatatggtgccggaaggaagagtcttccagagaagaccggcatcccagaggaaggggagggaacatgaacgagcatgattcagcttgcaccatcagcgtgccgcaggatatgagcgagagcatctctatcagagtgggcaggactgtagcggagctgcttgtccagcatgagcccgtctccttctactctgtcgcagagcgatcggctgtatcgcgcagcacgctctaccgcagggaagaccttcgccgtcttgtctgccgcgcccgcgaagggaagctcggcgctgcgggaagcgatgatgccgcttccgagatagcccggctcgagctcgagaatgccgggctccgccgtgagctcgaagaggtcaggcgcgagaggatgcttctccagcggggctggcaggcgcgacgacagcgccaggagcatgccctgcgcaggctgcacaggcatgcctcaagagcggcatagcgaggaataagagctcatccggaaagcaagaataggctgccgaatgacagcccgccatggagccatgccgagatggggcagagctcctgccgggcagctcattgctgctgcatatcgtgcttcgcccatcgaagcagcttttcggggcgtggcggaacggaagacgcgcgggcttcaggtgcccgtggccatagggccgtgcgggttcgaatcccgccgccccgaccaagtgcatgaaaaaacgtatcaaggcatcgggcgtgggctgcgatgctgctgcctgctgcttcggcagaggcagatgaaccatagagagattcagcagaaggaggaaagggacatggcagtgtatgcaaagtacacgcatgtcgagcggctcggcacagaggaatgcgaggggcttctcgacaatgattgcgtgtatgtctcgtccaagatagatggaacgaatgcctgcgtcttctgggatgaggagacgggtgcactcggcgcaggatcgcgtacgcgcacgctttctgccgagtcggacaatgccggcttcttcgcgtgggctacaggcgatgctcaagaggcaaagcttctgagagaatactgcagggcacatccagcgcaggtcgtctaaggcgagtggatgggcaaggacaggctcatcggctccttcaagggctacggcaagagggctctgggcacgctgttcatctacgacgtgctcgacgaggaggctggaggatatcttcccgagcccacgtggagaaaggagcttgccaaggcgggcctcgagccctatttcgtgaagcttctggctgtgctcgaccatccgactgaggcagatgttctcgatcttgcaaagaggaacgacttcctgatcgaggggaccggcaaggtcggcgagggcgtcgtctgcaaggtgcctggctggaagaaccagttcggccgcatggcatacgggaagatcgtgctcgacgagttcaagcggcagggaaggaagcctgcctttcatggacaggtggagcctgccatcatcgaggcattcgtgacggatgccgagatcgagaagacgatagcgaaggtatgcgtcgcgtgcggcaccgacgagttcgacccggcgagccgcaagatgatggggatgctcatctccttcagctggaaggacctgcttggggagtgcccgaactgggccaggaagttcaggaatccgaaggtcgacctcgggaccttgcagggtctctgctccagacgtgtcggcacatttgctgcaggcaagtattaggactgcctgcagagaggaaggcagggaagagcagcccgtacgggacggagataggcgtcctgtacgggctgcctgcttttatgggagggattcaggaactcctgcttacctcgagatcgaacgagttgctgtctccgcggtaggtggcaacggagtactccaccgctgtcccgtccgcatcgcgtgcgacggagtggaagacgatcagggggtctcctggctccacatcgagaagcgctgccgtggcaccttctgccttgatggcttcgaggtggcgccgtgcgcgcatgacctgcttcccgcattcgctcatggcagcatagaggcttttcgtgtcgaagtcatactggtcgagcccgggatagagcgcacaggggatgtagctttccacgaagacattgggctctccgtctgcatagcgcaggcgcacaagcttgtagacctcgtttcctggggagagctcgagcgcctcctgcaccgcctcgcctgcacgctcgcggcggaacgtgagcaccttcgtgctcggcatgcgtcctgccagacgcatcgcatcctcgaagcttgcgagctccatcgtgaatccgcgctggcttactttgggatgcgtaacggccgtgccacgcttgcggcgcttttccaggaagccctcgcttgcaaggatctggagcgcctggcgaacggtgggccggctcacgccgtaggcctgcgcgagctcgatctccgtggggatggtcgtgccctcgggataggtcccgtccttgatcttcgcgagaaggtcgtcctttatcctgtcgtagagcgtctctgccacgtctggcctttcgtctgtgtggatgcccccattgtaggtgactgggaatggcatgaagtaaggtatgacataaaaagtctgggaaagcggcaaattctggtccaggtacctgctgcttgaaagaatcttctgcaagaaagtcaggcaattgcggcatagaggtcagctataggcgctattatgtcagacataaagaccgacagaggcagaacatggtgcctgccttccggaaagggagcatgcatgaagcgctatacgatctcagagcttgcgtatatggtcgaccatacgaatctgcatcccgatgcgacgcgcaaagacatggagaagctctgccatgaggcagtgacgtatggcttccatatggttgccgtcaattcggtgcagtcgaagctctgctcgaccctgcttgctggcacgaatgtccatacgggcgctgccatctccttcccgctcggccagacctcgattgccacaaaggtcttcgagacgaaggatgcccttgcaaatggcgcgaacgagatcgactatgtcgtgaacctcacggaagtgaaggcgggcaactgggactacatcgcatcggagatgtcgcagatcgtgcgtgtctgccgcgaggcaggtgtgccttccaaggtgatcttcgagaactgcctgctcacgcatgaggagaagctgaagctctgcgaggtggcctcgaaggtgctgccgacctttgtgaagacttctaccggcttctcgacaggcggcgctacggtcgaggatgtccgcctcatgagggagcatgtcgatccgcgcgtgaaggtgaaggcggcaggcggcatccgcacggccgatgccttccttgcaatggtcgcggcaggcgccgagcgcattggctgcagtgccggtgttcccatcatggaagagctcaagcagcgtgcagccgagtccggcacggacatcttcgagctgtaaggacctctatgggaccgatactcttgaggccaaactacatctctcccgtctggtcaggtcctcgaatcaatgaggcaagaggcctcgaggcggatgtctggtacggcgagtcgttcgacgtctctgtacatgagggactcgtgaacatggtcgagggaggccccttcgacgggatgtcgctcgaccggctcatcgacgagcatcgagaagagatcatgggggagtgtgcaggcgatcctggcatcgtgcaggtgctcacgatggatgctgcccagaacctctccgtgcaggtacatcccgatgaggcgtatgcccaggcacatgagcacgaccacgagaagacggagtcctggtacatcctggcggcagatccgggtgcgaccatcatactcggaacgacgacagacgatgtcggggctctgcgtgcagctgcagcagatgacacgattggcgagcgctatgggcgccgcgtccctgtagaggaaggtgacttcgtgcttgtgccggcagggacgctccatgcactcggtgcaggcgtctttgcgctggaggtaggatccttcggcttcaagacctaccgcatctgcgactggggccgtggccgcgagctccatgtgaagcagggattcgatgtgctgaggactgagagcaggcctgagccaagaaggcttggcgccttggatccaaaggctcctgcgggcgttcgccggggcatcacgaccagcatcttcgtctctgatgtggctgatgtcagaggcagctggacgcaggatacctgtagccgctatcacatcatctcctgcgtagccggcacggcaaaagtggagactgaggacggaactgcagcgcttgctcccacacgttcccttatcgttccggcatctgccggaagctacaccgtcgagggatgctgccgcgtgctcaggagctatgcagcacgctcctgcgagttcgaagatgaaggcaaataggaggagacatggcaagagagcgggtcttgattaccggtgcgcacggatatcttgcaagtctggcgcagctctacaacgcaggcacctacgacttcatccgggtatcgcatagcgacgtggacttcgctgatcccgagcgggtagcagagcgcttcaggaaggcagacttcgatatctgcctccatatggcagcagatgccacgacggcacactgcgagaaggactccgaaggcacgcatcgcgtgaatacggagtccgctatcgagattgcccgtgtctgccaggagcggggcaagaggcttgtcttcatctcgaccgagcagtgcttcaatgccgcgccgggacaggcgccatactgcgagacggatgagatggggacggtcagccgttatggccagcagaaggcagaggccgatctctggatccaggagcacctcgaggactatgtgatcctccgcttctcctggatgttcggccttgcgctgccgggcgtgcatccttcccccaacatcctcacgaacgtgatgcgggcgctccgaacggatacgccgacaggcttccgcgtgcatgagcggagaaacatgacgtacgcacagagatttgctggacagctgccgaagattctggcactgccgtctggcgtctaccatcttgcgagccagaatctctatacgacctatgaggcagcacgggtgattgctgcacgtcttggctgtgattccagaatcacagagcgcatcatcctgcccgatgagaagacgtatgcagaggctccgcgcgatttccgtctggcatccgacaagattcaagctgctggcatcgagctcgggacgttcgaggaagatctcgatctctgcctgcgtgatttcgggcttgcatagagcggcaggcattctgtctgaaccagccggagcaggagggcttctcccgctccggcttttatgtcatggggagcttgcgtctgatggcggcttcgatgggcgctgcgcttgccggggttgatttcacctgtcatccgtacactccgggggggcaggtcaggattcctgcagctagccgaacggatgcagctgttgccgcggtcgaggccttcctcgaccagcctcctctccggcttcgtcagactcagatatgccctggactgggggcttcctccctttcttcctggatcttccggacatgcgatgtcagcttattcctgcacgtcgtctggccggcctctccggccgccgcgcacaggttccgccgtccatctgcacatgtacagctgacttccggaaccgttcgtatgaagtctgtaattgactcgcaaacagtcatatgacccaatctacctgggtgtttgtgatggactgtgcgcgcgctataatggccttgacatgggggagctggggctatggcccggctgagaggtggcacctcctgccacgacccaattacctgatccggataatgccggcgtagggaccagagcaacgtgttcgggcgccttacgagatgtagggcgcctttttggtgcccggaaaggatatgcatgaactgctctgtcgcaatccagtatctgccgctcgatgcggcaaccgatgaagaggtgtgccgcatcgtcgatgcggtcatcgcctacatcgactccacgggcatcgactacttcgtagggcccttcgagaccgctatcgagggcgactacgacgagtgcatggagatcgtgaagcagtgccagctcgtcggcgccaaggccggctgcaagcatgtggcgacctatgtgaagatcgactaccgctccgagggtgacgtaatgaccacagagcacaaggtggggaagtaccatcccacggacagcgagttccaggacaggagcgaagacgttgcctagcgaggatgtctccgaagagacggagaagaaggcagaggagctgcttgccgagcgcaggaagcgtgcgcaccgccgtgccgtcatgattcctgcattgacgatactggcgatccttgcaatctggcagcttgtcgtcgtggtcggcctcatcccgaacttccttctgccgagcccaacccaggtcatcacggcgcttgtgacagatgcaggccttctggcctcgcactccgtgacgacgcttgtcgagtccatcctgggccttgtgatcggcgtcgccgtcggctttgtcgtggcagtgctgatggaccgcttcgagggcgtggcactggcgctcaatcctctcgtcacgatcagccagacgattcccaccgtcgcaatcgcgccgcttcttgtcctctggttcggctacggcctggctccgaagatcgtcctcgtcgttatctccaccttcttccccgtgacggtgtcgctcgtctcgggatttcgctcggtcgaccccgatctcctcgacctcatgcgcacgatgaacgcaagccgctggcagatcttctggcaggtgaagctgccggcagccctgaatgagttctatagcggccttcgcatctcagctacctacgcaatcgtcggtgctgtcatcgccgagtggctcggcggcttcagcggactcggcgtgtacatgacacgcgtcaggaagtcgttctcctatgaccgcatgtttgccgtgatcatcctgatctcggccctctcccttctcctcatgaagggcgtcgatgcactccagaaactcaccatgccttggctcaaggcagaaaggaagaacagaaaatgaagaatctctcccgccgcgcatttttgggagcaggcgcccttgcctgcacgagcgctcttgccgcctgcggatcctatgacaactccggtgcccagtcccagtcgcagagctcgtctgcttcctcgtcttcggattcatccgaaacgacgcatatcgacttctgcctcgactacaccccgaacacgaaccacaccggcatctacgtcgcccagaagaagggctggtttgccgatgaaggtctcgatgtctcgatcatccagccggcagacgataccgcagaggccctgatcggctcgggccaggcgcagatgggcgtctcctaccaggactacattgccaatgcccttgcctctgacaatccgcttccaatccaggcagtcgctgccatcatccagcacaacacctctggcatcatgagccgccaggaggatggcatcacgtccgcaaagaagatggaagaccatgtctatgcgacgtgggacatgccggtcgagcaggcgacgatcaagcaggtcatggaggcagacggcggcgacttctcgaagctcaagatggttgcctactccgtggacgacgaggtcagtggcctcaaggcgaacatgttcgactgcgtctgggtctatgagggatgggctgtgcagaatgctgcggtccaggactatccggtgaactacttcagcttcatctcgatggatccggtcttcgacttttatacgccggtcctcgctgcgaacaacgacttctgcaaggagaatccggatacggttgctgccttcgtgcgcgctgcgaagaagggctacgagtacgcaatcgagaatccggacgaggcggcggatatcctgctcgaagaggtgccggagctcgactctgccctcgtgaagaagagccagacctatcttgctggccagtaccaggcagatgcctcctcctggggcatcatcgacgccgaccgctgggcagcctacttccagtggctcaacgacaacgaccttgtcacgaacaagctcgatgtcaatgctggctggacgatggactacctcgaggcttgaggccatggcagaatccgcaaacacgccagcgctcgaagccgacgatctcgtcctttcctgggatggggtccatgcagtcgtctctcatgtgagcatgtcggtagcgccaggagaggtcgtctgccttgtcggacgctccggctgcggcaagacgacgatcctccatgctctctcaggactcaccgttcccgatgcgggccgcgtgctcctgcatgggacagacatcacggggcatccgggcaaggtgagctacatgctccagaaggatctcctgctgccacacaagacgatcgaggacaatgtctccctgccgctcgtgctcggaggcatgaagaaagaggaggcacgtgcgaaggcggcactgctcttcggccgcttcggccttgaggggacgcagaagaagtggccctcggagctttcgggcggcatgcgccagcgtgcggcgttcctgcgcacctacctcatgggcaacgatgtgatgcttctggacgagccgttcagcgctttggacgccttgacgagagcagacatgaggagctggtactgcagcatggcagaggagctcggatatgcgaccctcatgatcacacacgatgtcgacgaggcagtgagcatggcacgaaggatctatgtcctcggcggcaacccctcagaaggaaggccgagccaccttgtcggcgagattgccgtgccaagaggagatctctccgcttctgctttcgcgctcacagatgacttcctctcctgcaagaagcaggtgctcgagcttctgggtgccaacgctacaagttgatggcagtgtcagcgatctgatgtgcgcaaggtcccttcggaggataatggatgtccatatccgatgaagggactttttcatgccgcttacgctcaattcggcgctctccacgcttaggccttcgggcatccgccagtttgcacgtctcgcgcatgagacgccggggtgcatctcgcttacgctcggcgagccgggggagacgacgcctgctcccatccgtgcagaggttgcacattcgctcgaagagggcaagacccactatccgccgaacaatggcacagctgagctcagggaagccatctcatcctacatggcagggcgcggccttgcgttttcgccggagcaggtcatcgtcacctcgggcgcgaccgaggccatctatacgatcctcacgacgatcctggagccgggcgatgacttcatcatccccacgccggcattcctcctctacgatgcaatcgcgcgcatctgccgcgcgaatcccataacgctcgatacgtcagaggacagcttccagatagggaaggaaaagctcgctgctcttgtgggccccaagaccaaggccatcatcctgaactcgcccctgaatccgacaggcaccgtgctcacgaaggaaagcctggctgctgtggctgagctggcccgtgagcatgacttctatgtgatctgcgacaatgtgtatgagcggcttgtctatacggacgagttcacgggctttgccgagagctatccggagcttgcggaccggacgattgtcgtgaacagcttctcgaagccctatgccatgactggctggcgcctggggtggcttgcggcgccagagcccctcatgcctgccctttcgatggtccacatgtatgccatctcgagcgtcgtcgcattcacgcaggacgccgctgtcaaggcgctggcaagcgatgtggagcccttcaggcagagctacgagaggcggcgcgacatcacgattgcagcgctccaggagatgggccttccctgcgtcgtgccagaaggcgccttctatgcattcccatcggtcgcagggcttgcagatacagatgggagccatatcggtgcggagcgcttctgcacccgtgccatcaaggaggcaggggttgccctcgtgccgggcacctgctttggctgtgccggccatgtacgcatctcatatgcgacagacgaggagacgctcaaggagggtctccgccgtcttgcgtccttcgtgggaagcctgcagaggatctgagttcgcaagctggagcagaaaagcagatggacatgaagagagggcagccagccggctgccctctcgtgttttctgctgtccttgccgtccgcccttatggcatgcggatcaggcgctcgtaggcagaaaggcccaccgtcaagaccgactcgtcgaagttgaagtctgcagcatggagcggcgtcttctcgccggtgccgagaagcaggaagacgccgggaaggtagcgctggtaccaggcaaagtcttcggcaataaggagcggctcgggcagaagctcgagctcgggaagcgcggcaagtgccttctggaagaggccggagtcgttcgtgaccgggggatagccctgggagaagtggacctcggaggtgcagcgctcgtcctctgcggctctggcagcgagatctttgacctcgtcctgaaggcgcgtgtccattgcgtcggagaagatgcgcaaggagccttcgagcttagccgtattggcaatctggtttctgacagagcctgcctccatgcggccgaacttcaggatgcagggctccactgtcctgcgttcctcgaggaggtctgcagccgcacgctggaagcggcaggcagcagagagggcatctgctccctggtctgccttcgcgatatgggacgccttgcccaggaacgtgacgtcggtctcatgcgagcctgccaggagaggtcctggcttcgaggcaagcgtgcctttcggaagatcgggccagagatggaagccgaagatcctgtccgcatggaccttcctgaagatgcccgactcgcagacaatccgggcgcctcccgtcgtctcctctgccggctggaagacgaggagcaccgagcggggaagctcatctgcacaggcgacaagatggtgcgcgagtcccagaagcattgccatgtgtccgtcatgtccgcaggcgtgcatcttgtgcggatgcgtcgaggcaaaggggacgccggtcgtctccgtgacgggcagggcatccatatcggagcggagggctgtcgtgtgctcgcttccgcggtcgaggaagaggcagacagtggagcggcaggggtggaggatctcagctttctgcccacgggctacgagggcatcccgcacgccttcgagctcgtgctcgatataggcaagcgtctcaggcaggtcgaaatcggtctctggtatctggtgcaggtcgcgccgccactggcgcaggtctgctgcagtcggctctttggacataggcaaggtccttccgtgctatggataggttgctacatccattgtgatgcagccgtgtggggccgctgtgggcgccgcgcatccattctgttacagggacgggagcattctggccccgctccctataatcggatgcgtatacgattgtaggtgcatatcgatagccacatcaggcatccagggaggcgccgcgtgcagaccagacatcccttcgcgacgaaggagcagctcgaggagatagcgaagagctatccgacaccgttctatatctacgatgagaaagggatcagggactgcgccgagcgcgtcaaggatgccttctcgtggaatcctgcctacaaggagttcttcgcaatcaaggcaacgcccaatcctgtcctcatcagcatgctccatgagtatggcttcggcgtcgactgctcgagcaaggcagagctcatgctcgcagaggctctgggcatcacgggccgcgatatcatgttcagctcgaacgatacgccggaagaggagatggcctacgccgtcaagctcggtgccggcgtgaatctggacgatatctcccatatcgcgctcctgaagaaggtggcagatccggttcctgagttcgtgagcctgaggttcaatccaggcggcgactttgccttcgcaaatggcatcttcggctctcctgaggatgcgaagttcggaatgaccgaagagcagatcttcgaagccgtgcgcgagctctccgaagctggcgtcaaggagttcggcctccatgccctgcttgcctccaacacggtcacgaacgactactacccggcgctcgcacgcctgctcttcacgctcgccgtgaagctgaagaaggcattcggcgtgaaggtcacgctcgtgaacctctcgggcggcgtcggcattccctacaagcccgaagaggagccgaacgatatcgcgctcatcggcaggcgcgtagaggaggcatacaacgagatcctcgtaccggaaggcatgggggatgtcgctgtcgcgaccgagcttggccgcttcatgatgggtccctacgcgggactcgtcacgagagtgctccatatgaagcatatctacgatgactatgtgggtgtcgatgcctgtgcggcaaacctcatgcgccccatgctctatggggcctaccatcacatcacggtcatggggaaagaggatgtgccagcaacggagcgctacagcgtgacgggcatgctctgcgagaactccgaccgctttgcgacgcacagggcgctgccgcctgtcaaggtcggcgacctcctcttcatccacgatgtgggtgcgcatggccactcgatgggctacaactacaatggccggctccgttcagcagagctcctgctcaaggaggacggttcggtcgagctcatccgccgtgccgagacgccgctcgactacttcgcgacactcgatgtgctgccggtcttcaagaggctcgaggccatcgagcataggctggataacgaagaatagacgtatctgacagggaaggagcgtccatggacgcacaggaaatcatcgactacatcgctacggctccgaagaagacgcccgtgaagctctatataaagctcgcgcctgaggcagagatggactggctcgactggggagacagcaaggtcttcgatgctggccagaccgccattgtcttcggcgactgggcagagcttgcccccgtcgtcgaggagcatgcagaagagatcgaggacatcgagatcgagtgcgaccgcaggaactccggcgtggcacttctcgacctcaaaggcgtgaatgcccgcatcgagccgggtgccatcatccgcgagaaggtcgagatcggcgacaacgccgtcatcatgatgggtgccatcatcaatatcggtgcggtcgtgggcgagggcacgatgatcgatatgggtgccgtcctgggtggccgcgccatcgtcggcgcacactgccacatcggtgccggcactgtgcttgcaggcgtcgtcgagcctgcctctgccacccctgtcatcatcgacgacaatgtcatgatcggcgccaatgccgtcgtgatcgaaggtgtgcatgtcggcgagggtgccgtcgtcgctgccggcgctgtcgtgattgaggatgtcccggctggcgccgtcgttgccggctgccctgccaaggtcatcaagatgaaggacgcaaagacggccggcaagacggcgctcgtcgatgcgctgaggacgctctagattttcagatactggctgcagatagaaagagaagcgctcccggaagcgctcccggagatggcctccaggagcgcttcttcctatcatgcatagatggctctactcggtcttgaggaaggctggtagcccttgtaggcattgaagatatcgatcttggacgttgcctccaaggtgcatgcatcgagagcacgggcacgccgcagtccacgacatccatatcgtacttggcaaggatgtaggcaatcgtgcgccgccaccggcgtcgacgcggcaagctcggctggtgccacttgacgtctgcctcgtccatggcagcgcggactgggccaggtactccgcgtcagcatcgttcgagccagccttgccgcgcgagcctgtgtacttgttgaatgaggccacgcccgcggaagcaggaattcttcgtccgaagaccgaggcaaagctcggatcgaagccggccgatacatcgtcgagagcatgcgggagtgctgaggcagcgcctcaaggcaagcggcgaggtctcgccgcaagtgccagtacctctgcgtcgtgtcctcgaagaagctgctcgtcatgccgttgcgccgacagagccgatctcctccttgtcgacgagaagcgtgacggccgtgcgtgccggtaccggattctcgagcggggcagaagggacggatagctgcagacgcggtcgtcctggccataggccaggatcatcgagcggtcgaagccaaggtctctggcagcgcctgccggcacgatctcgagcggccgagaggaagtcctcttcctcgattgcgtagcgctctttcaggatcgagagaacgtgtgcagcgacagggtccttcgcctcgtctgcgtctccttcgatggcaaggctcattgccgacaagaaggtccaggatctcgcttcgacagctcgctgccttttggacatctggtcttccgcgagatggggagaaggtcggtcacgcagaagacggggtcggacgggttctcgcgagcgcgatctggaccttcgtgccgtccttcttgcagacgacaccgtgaagggcgagcggcagcgcagtccactgatagctcttgatgccgccgtagtagtgcgtgtcaaggtaggcaaggcccgacattctcctcgagcgggttctgcttcacatcgagccggggcgagtcgatgtgggcggcgaggatgttgagtccctcctcgagaggcttcgtgccgacctcgaggagcaggagcgccttgccgtggttcgtggcatagaccttgtcgccggagacgagctttgctccctcggcgatgaggctatcgagtgcacggtagcctgctcttctgccagcgcagctgctgccgcgcagcactcgcgctcggttgtttctggctgatgatgccttgtatccctcgcagaaacgcagtgctcctggcgctcgtcctgcgtcgattccttccagcgttcggtgttccatggaacctctttccggctgatggatgcttataaaaactgcatccatgtgccacaggaaccaggagcgttgcgctgtgcacagaaaagggccgcatcccgaaagatgcagccctcgatatgccaggctgtgggcagcttgctatgagttcgtggagttgtcgtcgtggagtggtcgtgcctgtgcccggtgtgccggagccagacgtgctgctcgagctcttggagctgtccgtcgagtggaacccgagctcgtgcctgagtttgaggagctgttcgagtcgaggaatcagaggatgtgccggaattcgagctcgaagagttcgacgtgccggaattcgagctcgaagagctggagctgaggaggctgaattgtttgatgtggagctcgacgtgcccgtgcctgacgtgccgctgttcgacgaggagctcgggccagaagcgttcatcattcgcatggtgctcgaggtgtgcggagttcgtagacgaggtagtgcccgtgcggagttcgatgtcttggaagacgatgtggcgttcttgtcggaagacgtcgtatccgtcttcttgtcgtcttctggtcgcttgtgtcgtctgcgcttctcgctctgctgggcaggagcggcgaatgtcgtcttcgtgccgaggccgtttcctgcggtcgcgacattgatcacagctgcgccgattgcgaggcggcgaccgcggcaatggaggtcacagcgatagcgatgcgcttctggcgcttgcgctgggagtcggctgccgcaagcatggagtcggagcgatacgctggccgtcagggccgatctcatagcttccgagctcggaggagtccatgacacctcgatctgctcttcgtgctgtctttgaggctctgagcttgtcggcagagcgggaaaggatgttcttatagatgcgggtccgagcaggcggcagcgccgaggccgacgccgatgatggagccggcgtgcgatctgggaggagaggagggtggaggtgacagcggcaagcgcgttgcggtcacctgggcaaacgagatgtcgctgaacatccccttgtccttcttgccatcgccgctatcgtttccgtctccgccctggccatatgggctctgggaggagatgttctgcgttgcctggacgccgtaggggttctgggaagcgagttctgcgtcgcaccgtaggggttctgggtgggtagttctgcgtcgcctgagaggcgtagggagaatgctgcgcatgtgcggtgcggatgcgtgtgcctgggcacccggtgccacgacggtcgcatcagcttctttgtgctccgggaagagctcgtggagtgccggagcatctgctaccgttgcctgctgggtctcgtcgcttgcactaaatgtctgtgttctatcgttcgaaccataggcctggggattgtagacctgggtcttgccatgtcttcgtagacaggatactgctccttggaaagggatgggctccatggacaaggggtcgttgtctttcggagggttcagtatagcggcggcgtgtgacaaaaaagtaggcagaaacgggggcgtgcccaatctctacagctgctatagaaagcgtcagcaaatcttgacaaaacggaagtctacctgaactttgcagtgcataagtaaagcgattctatgctcgggaaggacttctggctcggcctgtgccgccttctggcgaaatcttatgcagtattgaatgcagcgcatgaaaggtgctgcaaagcggtaaaatctgaattgtcagtgtttgcgctctgtcaaaaggaggtaacaatgttgtcaatgcaacgcacatgccagtccgccgagaagggccactacggccttggtgcttcaaacacaacaacctcgagtgggcccaggcaaacctgaccgcagctgaggaggagcagtccccgctgatcatcagtgctccatggtgcagcaaagtatcaggggctacgacgtcgttggtgctatcgtcaaccacctcgtcaagaatatgaacatcacggttctgtggcccttcacctcgaccacggcacctatgaggcctgcttccaggcaatggacgtggcttcacgtccatcatgtacgtggctcccacgaggagaccttcgacatcaacgtcgagcacaccacggagctcgtgaagcttgcccatcagaagggcatctccatcgaggctgaggtctggtggatcggcggtaccgaggacggcgtcaccggcatgggcgagattgcagatccgaggagtgcaaggtcatcgctgacctcggtgtcgacttcctcgcctgcggcatcggcaacatccacggcctctatccggcaaactggaagggcctgcagttcgacgccctcgcagcctcaaggagaaggcggcgatcttccgctcgtccttcacggcggcaccggcattcctgtcgaccaggtcaagaaggcaatctccctcggcgtctccaaggtcaatgtgaacaccgacttcaggtcgtcttcgctgaggtacccgcaagtacatcgaggctggcaaggatcagcagggcaagggctacgatccgcgcaagtcctcgctcctggcagcaggccatcatcgaccgcaccaaggagctcatggaggagttcggctccgtgggcaagggctggagtaagcttcaaacccagtgccaatcaggcgcagagcagggggctgcactcggtgcggccccctttttcatgccgagatactatttcaggtatgttgaagacgttcgcaggttcttcgaattgccccaaaagggttccattgaaaatcgagtgctgtagacttgagaccgttagtatacgccgaaggacatcatgttctcggacgaatgatgaccgaaaggggcttcatgacgcgcagaaagaatgttgcttttgcaatcgcttccgtgctgacgttcggcggtaccctcgggcatctctgttcctgcccttgccgaagactcggcgacgctgcagacgcagctcgatgggcgaactctcagctctcccagatgggctaccagctggcagctgtacaggaggacccaacaaaaccgtcgtccagctgaacgacacccagtcgaagatcgacagctcaactccgatatcgcttccaagcaggaagagctttcgcaggctcaggccacgctcggcaagcgagtctccgcgaactacaagcgggcggcgtcaactgtctccctcgtgctcgactctgacagcttcgaggacctgttctcccgcatctactatgcagacaaggtcgcagagtccgacgcccatgctatcagccaggtgaagacgctccagaacgagctcaaggaccagcagtccgagcggctcagacagaagagccagcaggagtcgcttgtcgcacagaagtcttcccagaccgagtcccgcagtcccagatttcgacccgcagtcctacgtggatccctttccgatgaggtgagggcggctgttccaggaagaggccgacgcacaggctgccgccgcacagcagaccgcagccaatgcaggtgccatgcttccgaactcgcacaggctgcacttgatttctcctcgagcagcacttcgtccgatgcggctacgacgggaatggcggaacgtctgacaatggcttcgggcacgagctcgaacaccgatggcggcaccaataccaacaccaatacgaacaggatacgacgccgtccaccccatcgactccgtccacgccgtctacgccgagcacgccgtctacaccttcgacgccgtcgtacagcaatagctcgagcgatacgtgcaagtggcctcacgaggcccagcgctctgcaatcctgagcgttgctatggcgcgcttggcacgcgtacgtgtggggcggcgcctctgcttccggctatgactgctccggcctcacgatggtcgcctatgcagcagctggcattcgctgccgcactcctccgatgcacagatggcctacttcacgtccatcccgctgtcccaggcacagccgggcgacctcatctggtactccggccacgtgggcatctatgtcggcaacaacacgattctccatgcaccgtatcctggcgtctatgtcaggaccgaagggtgtggggcggctatatcatggtcggcacctaccgctaggatctcttctaagagaacatgcagaaaggcacggaagggcatctgctcctccgtgccttttcctatgtgccgatagttctgctcatcgagcttcggatcatgcatggtgtatgcagcatgaggctctgaggatcgtgtcgtagaagttggtgtaagcacctgattgcctgaaggcactcctgcgggaaagaaggaggcccccgtcctagaatctggaatcgcgacattacaggttgtggaaaggacgaaggcccaatggacgcatagcagagcaggctgtgtgcacggccgcggcaggagagatgccgaagttcgcagacgggagcataacctccaggagctcttccgccagctggcggtagtcggtcataatgccgtgatggatgcggggccgaggagatgtgctcggcctccggcaacagcaggaacggtacaggccgaggaccctcaatacctgcgtggggatgctgaacctgaggataccgaggttcaggaagggaagttcttccccgacgacatctcgaggctaccagaggaccgacagggcgctcatcgccgccgtggcggagatgtacgagaccggcgagcacgaggaaggtccagaggatagccgagaggtgggcatagacaggctctcgaaggacaggtgagctcgattgccaggagcctcgatgcggatgtcgaggagctttcagagcgcgtgcactccctgggagggctggacatgccctacatctggctcgatgccacctacgtgaagtgcaggaggagggggcacgtctcctccacggccatcgtcacggccataggctgcgatgcggacggctggaggcacatcctggggcttgcggtcgtcgacaccgaatcgcacgcatcctggaaggagttggagaggatacgcggagagggcgtggaaggcgtccagctggtcacgagcgatgcccatgaaggcctgaagcgcgccatatcggaggtgtcctcggcgctgcatggcagaggtgcgccgtccacctcatgagggactgcataggggctgcaggatcgagggccctcaggaggcgcgtcgccaggatcatgaagcccgtcttcagggcgaaggaggcagaccaggtgcgcgccctctaccacctcgcagcggagatgctcgaggaatgctgcgaaggggggagatctgggaggaggcggagggatgccctagcacctcgacttcgcagtcactggaagcgcctgcgcagaacaatgtgcgcaccaaccgcgagatcaagcgccgcacgaaggtcgtgcaggtgttcccctcggagaggtcgctcctgaggctcgcaggcgccgtccttgcagaggcaggacgaaatctgggccgacaagcgctacttctcggaggagaggatggcagagctctcgaaggagaggaggcatccctcccgcccacgccggagaggctggcagagctcagggagaccgcgcgcaaggcgattccgaggcgagcctcgagcttgcggacgggatggagtcggcataggatagcggcagcaattccggatccaggacggcctcctcgtgccagacaggaagggccattacaccaacattgccgacactaccgctctgagagcatgcgagagcatcgatgcggcctgcagtggggagagattgcctctttgatagaagaagggcccggagcggctgctccgggcccctcagcatgcaatgaagctgcttcaaggaaggctacttctccttgcccttctttgcgtcgcgttcctcgagcttctcctccgcttcgcgcagcgccagctcttccggcgtgagctttgtgaagcctgccgagagcgtgatatcgcggagcgtcttcgagtcgaggtactccgaggtgaccttgccgagatcgcggtagatcatgaccgtggggcagtccttgaggtgcgagcagatatctcctgtgctgcagtcaaggcaggcgacaggggcaagcgagccttcggctgcacgcaggatctcgccgagcgtgtagtcctcaggctttctcgtgaggcggtagccgcctcccttgccgcgctggctctcaacatatcctgccttgtgcatgagggcaatgacctgctcgaggtacttcctcgagatgccctggcgcttcgagacatcgccgagagagacccagccatcatgtgtggcgaggtctgccatggcacgcagggcgtagcggcccttggtggaaaacatgttccccgccatgatcagtccttgtcctccgtcgtggaagcctgggaagtgttccccttgagcatctcctcgagcgtcctccaggagagctcggcgcacttgacgcgtgccggcatgtgggagacggacttcaggcttgctgcctcgtcgagctcgtcgagctctgcatcgtcggtcaccttgccggtcaccatgcccatgaagagctcgcagagatgaatggcttccgcgggggtcttgccgaccataaggtcgctcatcatgtcggccgaagcctgggagacggcacagccgtggcccgtataggcggcctcttcgatcttgccgtcatctccgagcttcacagacagcgtgaggtcgtcgccgcaggaggggttgatgccctcatgcatgatgctcgggtcgttcatctggtacttgtagtccggatgggcgacatggtcgatgaactcggcgttgtagagatcagttgcttccatggaacacctgccaaacgaatctgagcgcatcgatcagctgatcgatgtctttcttctcattgtagaacgcgacagaggcgcggcagcagctcgagatgcccatagaggtcaggagcggctgcgcgcagtgatggcctgcgcggatgcagacattgcgcatatcgagcagcgatgccacatcatgcgggtggatgcccttcacattgaaggagacggcagagacatggcggtcaggggaggcaggaccgaccatctcgatgaagggaagctcttcgagcttctcggtgaggtagcgggcaagcttgcgctcgcgggtctcgagcgctgcaaagtcatggtcttcgaggtaggtgattgcagcacccgtcgcaaagatgccggcagcatcctgcgtgcccgcctcgaacttctgcggtaccggcgcccagacagcggcctgctccgtcacggagtcgatcatctcgccgcctgtgaggaacggaggcatcttgtcgaggatgtctgccttgccccagaggacgcctatgcccatggggccgccgagcttgtggccggagaaggccagaaggtctgcatccatcgccttcacatcgaccttcacatgcgggacggactgggcgccgtcgacgaccatgtaggcaccgaccgcatgcgcatgcttcgcgatgtcggcaatcgggttctcgacgccgaggacattggagacctgcgtcacagacacgatcctcgtcttcgggccgatcttcttctcgagctcctcttccgtgaagcggaagtcatcatcgaagcgcaggtacttgagcgtggcgcctgtagcggcgcagacctgctgccaggggatgatgttggaatggtgctccatgatggagacgacgacctcgtcgccctcatgcaggaccgtgcggccgagcgtccaggcgacaaggttcagagcctcggtcgcattgcgcgtgaagacgatctcggagccttgaggctctcccgcatcatccacagcgccgatgaagcgggcgatgtgggcacgggtcttctcgatctcctcggttgcctcgacagagagcttgtagaggccacgcaggggattggcgttcatcgtctcgtagaaatgcttctgcgcctcgaggatggcagccgggcgctgcgctgtcgcggcagagtcgaggaaggcaagatcaggctgtgctgcgagaagcgggaagtcctgccggaatggattggtttcgatgtcggcggtatccatcatcggtcctccttatcgagcgcaaggccggcaagcgcatcggcgagggcatcctcgccgaggacggccttcatgcgggtgccaagagctgccttcgactgggcctcgggtgcgtggatcagcgcgtcgtcgaagatagcctgggcaaagagcttcgagacgccgtcttcgccgaggccgcgggcagcgagatacatctcctgctccgggctgatcgagccaatcgatgcgccgtggttgccctggacatcctcctcgtcgcagaggatgacaggaagcgtcttgttgacgatatcgtcgccctcgacaagcacggtctcgagctcgttgcccttggagcccttgccgccatgcacgggctcaatcgtctcgcgcagggtcttcttggcagcttctgccagaaggccggaggcgttcatgtcgcagcgggtgctgcagccgcgctggcgcaccttgtgggtgaggtcaagctcctcatgccgcgcacgaggtagcggctcacaaggtcgaaacgggcgttgtcctcggcaaggtcagcggccaggccggcagcgacctttgcgccgccagcgcatactggcgcacatcgacgcacgcgttccttgcagtacggatgccgatgccttcgaggcgggtgctcttcaggcagcgccatgatctcgatgaatggacctgggcacgtgctctgcaacgacgcgcacgaggttcgcagaggtagctgcatctgccttctcgccacggagcgacgacgatcgtcgcctcggctggatggcggaccatgatgccggtatcggctacctcgcctttgtcgccgtcgacgacgcagacgatgggctctctcgcttatggtgtgccggcacctcgatataggtggcgtccttggcagcgtcctcgatccaggagacggcctcttcgccgatgccgcactcaagggcatcgaagagacgggggaggcgtgcatagacatcgcctgtcgccttggcggcagggaccgtaagcgaggtctcatcgtcttgaggtagttccacgtctgcgcaggcggaacattgatatggggagcgtggtgagcgcttcttgcgtgtctgccatcagccgatcgctccttccatctcgagcttgatcaggttgttcatctcgacggcgtattcgagcgggactccttggagaccgggttcgcgaatccgttcacgaccatggtctgcctcctgctcggagcagccgcgctcatcaggtagaggatcgtatcgtccgagatgcggccgatcgttgcctcgtggcctacagaagcggagctgcagcgcactccatggcaggaatcgtgtcggagcgggagatgtcgtcgagcatgagggactggcaggagaccgtagcccttgcatgctctgcgtgcctgccaacgacgaccgagctcctgaacgtgttgatgccgccgtccttggagatggacttcgtctcgacggaagcggtcgtatcgcggccgttcaagattaccttgcagccggtgtcgaggtcctgcgtggcgcctgcgaacgtgatgcccgtgaactcgcagtcgagcggtcgcctgtgagatcgtcgtcgggtagaggtaggagacatggcttccgaaggagccggagacccactccatcgtggcgtccttgccgatcgtcgcgcgcttcgtgttgaggttgtacatgttcttcgaccagttctcgatcgtcgaatgcgcagacgtgcccatccttccgaagagctcgacggcaccggcgtggaggtttgcctcatagtacttgggtgccgagcagccttcgatgaagtggaggttcgcgccgggctcgacgatgatgagcgtgtgctcgaactggccggcaccggaacgttcaggcggaagtagctctggagcggatactcgaccgtgacccctgccggcacatagacgaatgagccgccggaccagctgcgtagtggagcgctgcgaacttgtggtcggtgggcggaatcagcgtgccgaagtacgcttaacgacaggctcccacttcggattgtggatggcatcctcgtcgtcttgtagacgacgccgtacttcgcgacccgtcgcgcatgttgtggtagacgatctcggagtcgtactgggcgccgacgccggcgaggctgtcacgctctgcctgcgggatgccgaggcgctcgaacgtgtccttgatgtccttcggcacgtcgtcccagttcctggcctgctttgtcttcgggttcacatacgtggagatgtggtccatatcgaggcgggcgatggaggggccccagtttccggcatcttcatgtcctggaagagctcaagcgcttcaaggcgcttcttgagcatccactcgggctcgtccttcttctcggagatggcacgccacgatatccggcgtcaggccgttcgcgtacgctcgtaccctcctccggcttcacgaaatcatagagggagcggttgatatccgctaccgtgtcttcttctcgctcacagcctcacgcctcctggacttctcggagttctcgagtgcctgctcgaagcggccgaagcctggggtgtcgattcggtgatgaggtcggcggggccctctccacgaggttgccgtggaccatcacatgggtgcggtcgacagagagcttgtcgaggagcgcgtattgtgcgtgatcatgagaagcgcgccgtcgcagtccctagtgacttcgatgcccttggagacgatcttcagggcgtcgacgtcgaggccggaatcggtctcgtcgaggatggccagcttcggcttcaggagcaggagctgcagcatctcgatcttcttcttctcgccgccggagagccgacgttgagctcgcgcgtcaggaacgactcgtccatatcgatcatcggcaatctcgttcacgcgctggcggaacttgcgtgctgtcgtcttgagctcggggcgcatctgcgtgattgtgccaggaacgttgtagagaggaacgccagggacctcccggtcctggtaggagaggaagatgccggcaagcgagcgcttgtcagcagcaagctcggtcacgtcctggccgtcgaagacgatcttgccttcgctcacgatatactgcgggtcgcccatatcacatggccgagtgtggacttgccggcgccattcgggcccatgaggacatggtctcgcctgcacccacctcgacgatatattgtcagatgggcttgtcttcggtgcccgctgaaagattgctcacctggagcagagtctgggacatagttctctccaaaacgctcgcgaggccttccggtctctttccggctgcggtgtgcacccccctgaccaattcatagtactcgtaggggtatttaggagacaagctccgaacaaagcctgcaaagtgctgatatcatggtccctgcacgccttgacgggcgtctttcataattcctaccgtactgtgggttttaccgcctcattccatttctataccggccaattgcgaccaattgaggacacattctccgaatgtgcacaatgcagggctttgacggaaatccggccatctggatgggtcccgaaacgttgcagtgcggttgcagcgtgcggatgtccgctccttccgctatagaatgttgaagcaatcagaacgcacacgagaccgaaaggcaggaataccgcatggctctttcgagagaagatgtggcagggattgcggactatgcccgcatccatctgacccctgacgagctcgacgagatgacgcagtactgaacgatgcaatggacatgcttgcgcctatccggcatacgacctcgatggggtggagccgaccttccaccccatcggagacctctcgaatgtgatgggcgaggatatcgtcgacgattcgtccgccatctcgatatcgatacagcgctccagaatgccggctcggtgcatgagcgctacttcagggtcccctcgatcctgggcgatgaggaaggagaccgctagtggcagacatcgacgagctctcggcatcccagattgcccagggcgtgaaggatggctccttcagcgcaaccgaggtcgcgaaggcgacgctcgacgcagtggacaagcgcgaaggcgatatccaggccttcctcgagatctcgcagacctcgcgcttgcagctgccgagcgcacagacaaggcacgtgcgaaggggagcctccggcatccttgccggcgtcccctgcgccttcaaggacaacatgcatcttgtcggcacgcacacgacgtgcgcctcgaagatgctcgagaaacatgagtcagtgttcacggcaacctgcgtccagcgcatgctcgatgcaggagcgacgcctgtcggcaagacgaacatggacgagttcgcattcggctcttcgacggagtcttccgccttccaccgcacgaacaatccgtgggacacgacgagggtgccggcggctcctcgggcggatctgctgcagcggtcgctgcaggcgaggtcacgctctcgctcggctccgatacgggtggctcgatccgccagccgcaagcctctgcggcgttgtcggcatgaagccgacctacggtgccgtgagccgctacggcgtcgtcgccttcggctcctcgctcgaccaggtcggccccttcggcaggagtcgccgatgtcgcactgcgatgaatgcgcttaccggtcctggacgcgacccgtatgactcgacgagccagaactgcccggtgacttcctcgagcatctcgaggacccgatcgagggcaggttgtcggcatcgccctgagcttatggatgctcctggcccacgcaggagtgaaggatcgcttgccggtgccatcgcagcgctcaaggaccaggggtgcctctgtcgtcgaggtcgatcttccgaacatccgctccgccattgccgcctactacgtgatcgccccctgcgaggcattctcgaaccttgcccgcttcgacggcgtccgatatggcaccaggagccgaactgcgcaacgctgccgagcagacagccaagagcaggagccatggcttcggggaggaagcgaaaggcgcagatgctcggtgcctacctcctcgcttcgggcgtctacgcagtactactatcggcgcggcaggtacgcacgctctcacccaggactatgtcaacgcctacaagaagtgcgacgtgatcctcatgccggcggcacccgcacggccttccgcttcggcgagatgagcgatccgaccgagattatgcctccgacatgttcacgatttcgaacaacatgccggaatggcggcatctccgtgccgctcggactcggcgcagagtcgaagcttccggtctcggcacagctccaggacctgccttctccgacagaagctcctgcagtttgcacgcgcgatcgagcgcgccttcacggctgaaggcaccgtcgcgcctgcatttgccgggaagggaggcgagctcagatgatgccgctcgaaagggtgctcaaggactgggaaccctgatcggcctcgaggtccacacggagctcacgacgctcgatacgaagatgttctgcaactgccgcctctcgcacaacgatccgcccaacacgaatgtgtgcccggtctgcctcggcatgcccggcgccctgccggtcccgaacaagaaggccatccagtccttttcatggccggccttgcgacgaactgccagatcatgaagcactcgatgttttaccgcaagcactacttctatccagacatggcaaagaactaccagacgacgcagggcccagttcctcttctgcatggacatctcgacctcaccgtcgacggagcagcgcgaaggacgcctgcctgggagatatggcagctgacggcacaccgatcgagcgcgccgaggacggctctatacgcaccgatcaggatcttgcgtatccccatggaagaggtgctgcaaagatggtgcactcgggcggcgaggaaggccgcatcacgggtgctgccgagcattcgtcgactacaccgctgcggcacgccctgatcgagcttgtcacggagcccgacactcaggactcctgaagggcccgcctcttctggagaagctccagcagacgttccgcacgctcggcatctccgactgcctcgccgagtccggctccatgcgctgcgacggcaacatctccctcggcgccgcggagagacgaagctcggcacgaagaccgagatgaagaacatcaactcgttcaagagcctccacgtgcactcggtacgagatccgccgccaggcagaggtgctcgaggagggcggcattatcatcagagacccgccactggggcccaagcgccgtactgtcgtcatgcgcgtcaaggagacggcagacgactacgcctcatgcccgaccccgacctggcacccttcgaccttaacgacgacttcatcgacgactgccgctcgcgcatcccggagctgccggatgagaagtgtgcacgctacgagcgtgactacggtctcaagcatgctgacgccgcgcagcttgcaggagacccggatgtctcgaagttcttcgaggaggcgcttgacggcgccgacaagaagacggtccccacggtcgcgaatgtgtatggtgaacctcgtgccagggcatgccgacgtgaagcctgcccagctccagagcctctccaggcttctggcagaagatgcaatcacgttcgcacaggcacgcgaagtgctcgatgcggtcgatggaacggacaaggatccgcagctgtcgtcgacgagcgcggcatgccacaggtctccgatgcgggcgctcttgagcccatcggcgacgaggtgcttttcgcgctgcacggaccaggtcgcacagtatcagggcggcaacaagaagggtccgggataccttgtcggccattgcatgaaggcatcgaagggcaagggcaacccgaagcgcttcaatgagatgctgagggaaaagctcggctagctctcaggacagaactcatcgaggggctgctctgcgggcagccccttttcatggagttcacggctgtccatgagccggcccgaacaaaacagatggaagcgggaaatcgacgtctgcggccgaatttggccgttcacgcgggcgcaagatttggaacgcttatgcgggacatcatatgatgcgcaagggcagacaggacaaggagtggactcggcacctcagaggttctgccaagagcccggaaagtgggggtcccgtgatttcgtccgggcccccgtcaagtctgaagacatatataagagatggagcgctaggcttccttcttctcctctgctgcaagcgcatcggttgagaactggcggagcatcagggcacggtgacggccaagccttcggcagctcgtcgcatcgatccattcctcgcgcgtatgggcaccgccgccgacatcgtgccgaccgaggtagcagggattcccatggagagcgggatgttcgcatcgttcgaggcaggggaggtatcgggtgcagctcctgcaatctctctcagcgcatcgaggcaggcgttcgtgagctcttcctcatcctcctccgggatatcgccgttgccggggcggctgccgatggggaatgtccatcgtgcagccaggcacgcaaatgaggcgacgatctcgcggagctctgctcgagctctgcgagcacgctctcgtcggtcgaacggaactcgaagagaagcgacgcatcctcggcgatggaattcacggtcgtgccgccttccatcctgccgatgttcatcgtcgtgcgcggatccttcggaagctcgagcgcatagaggcgctcgtgagcgcacagaggcgctcgagcgcgttcggcgttccgaaatctgcccagaggtgtccgccctgcgtatggcagctgatgcggaagcggcgcgatcccacggcgacagagcagcactggggcatgtagcggtcgaatgagatgtattcgtggatgcgggtagtgcgggcgagcttctctcgaagacctggcggtgccatcgaggttgccgaggccctcctcgcaggaattcgcgacgatgagatgccgcagtcgagatgctctgcaatctcggtgatggcggatgagttagcgtgccgcaagaaggagcccgcgaggcaggccgtgtcatcgccgatgcctggcgccatgatcttctttccatccccttcggggtggaaggaatcgcggtcagggaacacgacatcgtgtgttgcagcaaagaccgcaaggtccgaggcgagccatccttgtggcgggggcgatgggcacgataacgtttttttcgggaatcgatgtaggcctgggggcgcgcctttgcatggaaccagctgcagacgaactgggcacgcctgccttcatggtgaagggggcaggaagcgaggcgagggcgcttgtcagcatgatctccttcgtcgtagacagtgcgtgcatatgcctttgcaagggcggtgagctttcgcgtccatatctgccttccggtccggttctcactggtcggccccatcgtagcaggaggagggagcccaccaggcgaaagcacgtttgccgaaacaaagtgccaaatattgcactcactgcaaaaaaacacggtttcgttcaatatctctgccctattagatacagagttccaaatggcactctgcccagtttccgcctaagaggtttacatgagacacagcggcacgtcttccatcgaatcggtttcctccaagatcctgcatgctgatgaactgtctgcaaaggcagaagcactgcgcgccgaccaagcagagaatgcgccttccgaagacagcggagccgaagcggcaaggcctgcctcgagacattcgagagcctctaccgcatctcgataccgctgcttcgctgcctttcgcagggcaatgcgaccgtgctcctctatctcgacacccataagcatgacacctctgcgtgccgccatcgcagaagaggtcggtgcctcacgcgcccccgcatcacgcagatcatcgacgacctcgaagagcaggggctcgcaaagcgtgtgaaggatccgcatgatgcccgcaagatcagggtcacgtcacgcgcaagggcaagaagctcgttgccggcacgcgccagagcttccagaagatcatcgaggactatggagcggtcatcggccaggacaagccgaagagctcaacggcatcctgaacgagacctatgcgcttttgcaggagttggctaggaagacgcctaggctaactggcagaaaagcttccctctgc

SEQ ID NO: 741 - DNA, 23069 bp, Unknown
  Metagenome-assembled genome
ccctacggtataccgggggtctatgtttcacatgatcctactcgtgttttggctgagttgtaaggcattggtgggtgtttcattatggtatcgtcatcttttcttgattaggtactcaattcggtcgggcagtccgaatcagcacgagtccaatatcggatgtccatccagtagccgtttaattcgagtattcatgtttgtctactttcatgggtggcgcccgtaggggttcattttgtggcaacgtcttatggtatttagtctggttgaactgcgtcttcgggttagcgcttgtcgtcgtgtttaatgattggctttttgcacactttgttttcatgatcacgggtggtgacacgacagtgcaacttcgctatgtatgattaatcggtctgaacatataaaacgtgtcagctttagattgttgttcggcgccgggtgcgtcctattcctacctccggggctgggtgccaaatttgcttgaacggcagccgacgtcgatttgagctaacgcataacccgcgtcatctcaaatacgagtcttattctaagccggaagaaaatcacttccgactaagaataatttggctactgagcattgtcacccagcccctccagtctcagcctgtgaggggccacgggttgaagccgagcattgcctagccatcggattaatgcggttttggcattagtccgttggcgtagcaagcacaggattcagtggcaccgagcacgtttcgggaacccgctcgaatggctaatgaacggccacttaacttagcacaatctgttgttggctattttgatacgggaactttaaacgaaacgttagggttgtattaaccactttgtcgagacggccaattattacgatgttgattgaggaatagtgagacatcctaatatcattttcaccctgacagttgattgataaaattattgtttatgaaaaacaatgacgaattcaccaaaagttgggtccgcacatgtccgccattcgaacactgtcccgactggaaggcgtttcggccaatactcagcactgcaagagtgtgaggttcagacgagttgagactgaggattagcctagctagggcgttaagcggtgaatttccgcttggcgtcatagcgtagctaaccgcaagtctcagtctgacccgaacacgtttcaccaatatggcattaaagcgtggaagaccagtatttaagacgtgggcttcggcttaaatctgtgtccaccgcgttctagcaattggccgaaatgcctggaagtcggcgtaggacgaacttgaaaagcatgtttacgcccactcgcacctgtttccagcggtttttagctggccgtttttgaacttaaaaaacgacacgttttaatcatgattaatcctaaaatgactagcacgatacctgttgttaagtaggctgttgatgtttgtgtaataacttaatgattggtataggcgctggcagtaggggacggttaattaatatgaagtatgctgatgatgagcttaatgaatattaaccataatcggcgttgaacttaatattagtcgtaaatcaattaaaaggattgtatttcagagaaaatggtctaaactctaattattcatgttagaagatgtaacatgaaatctaaataagagggttttgctatgcgaattgaagctgattgtattggtaagttagctgttccggatgatgctttgtatggaattcatacgttacgtgccgttcataattttccgattacgacggaattgatgcatccactgatcatgcaaagccttgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccgattgatgccggcagttgccgttcatcccaacgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcggacctttcatgcttattaccaattattcaagcgtgatttgacccgtgtacggcaggcgggcgaacatctccgaatcgtaaatttgggtgggactgcaatcggtaccggcatcaacgcgactcacacgtatcaacaacagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattgctggcgagcggcccacaagctggctttggtgaattgaatttgcccgcgcagcaagctggttcttctattatgccaggtaaaatcaatccggttattccggaggttgttaaccaagttgcgtttgaagtgattggtcacgacacgacggtaacaatggcagcggaagcaggccaattggaattaaacgctttcgagccgattatgttacgggcattgctaaccagtgagcagcatttacagcaggccttgactacattagtcgatcactgtgtgcggcaattgacggtcaatcgccaacgctgtgcagatcaagtggcacattcggccattacggcaactgttttggcgccataccttggttacgagacgactaccgcgctgattaaagaagcgctcaccactaaccaagcaattcctgaattattacatcgacgtcgcttgcttagcgatgctttggtcgagcagctgttttcgccggccggactaactcagccacgcccagaggttattgaacaactacgagcggttgcaaagtagccactgttttgcagtgcaatttatggctgagataggctagtgctgaaggttgacaccagccagtttaaagccaatggacgtcgcacgacttagcacaaactaaagttagcgcgctttctgccaattactaaaacgcagtggatccaagtttaagccgtatctcaaatgctagtcattaaaaatgagtcaccagaatgaaaaattctgatggctcatttttagttgtcgtttacttagtcttagctaaaagcagtgagacacattagtgtaagttgaccaaagcaaaaacgattggaatggtaacgacacttaaaatcgttgagatgctcattagggcaacggctggcccgggatcaccgtggactttgagcgagaacaagacgacgattccggcgactgggcaagcagccattaacactgtggtgaataatgggatgccagtgatacccattagctggaggacaacaatcgccaagtatggaaacaataaattgcgcaataagatgactaaccaaagacgtttatcgagtgttgcacggttaagtttaacgtctgccaaactattcccaataacgatcatggacaggggtgtgttgaccgaactgacatatttaatagcgctattggcaatcgttggcagttgcagcgaggttacgaagatcagtagcccaacaacaatggcgatgatattcggattaaagacgatctgtttaagattatcccgccgattgccctgttgtccggtgaagagggtgataccgtgagtccagctaaaaatattgaaggccgctaacgaggcaacagcatagaatacgccagttgcaccgaatagggagctggttaatggaatccccataaaaccggcattagaatatacggcaccgtaacgcataatgcgacgcaaattctggtcagagacacgtttgaatagtaattgcgtcacaatgatcatgagcacataaatgatcacaattccagcaatgatccgggctaacatttgtaagcggtcggctgaaaatgtcttttcaaaggcttgaataatcaagcaaggtgacacaatgtataacaggatgttggttaaatcagttgaagtctgggcatgcatgaagccgagcttgttaacgagcaggccgacgagcatgagaatgaacatcaaaatgatttgactagttagttgcgttaaattcatttacttcagtccaataaattagaatactctcattattgaggtttggcctgaactttgtcaagattcatttaggccggatgatgcgcctggacaatatccacgtgatgtttgagatggggaaaaacatgatgatcagaccaccccatgatggcaccttgagcaattaaggcaaaggccgtcctgaagccaatggcgcgcaaatgacctgtggcgaagaatgaaacgacgataatcgtcagaggtggcaaataactagtccactgggcaataatagcggaaccatgtaaaaaccgaaagcgtaagatatacgataaatcatcgttcggatgctgaattaaattacaacgctggtaaatcgagacggcggccgcaacgcctaatagcccaagcacgtttagaatcaagcgtggtaacaggggcagggcgggaatctgtagccaatcccaaaagtagccgataaattggaccaggtaactaaagggcacgatatagagcaagttggagataaaccgacgccgatcaaagtgacctaacagaagttggttgagaatcgtgacaaccacaccgtacagtaataaggtggttcctaatgaaatatgggtccagtcagctagattaacgctggagccagtccagacggcgctgcctaggctggtggcgatggtgagcgcgttggcagcagaattcagaataatggaaaagactaaaaaaccaaaacgttgacgaaaatcaggaatgttcaacacgactaagcgacctttcagttaacagtatatgagttattataaccgctttcataagtggatgtcacggctagactcataaaaatatgctatactaattgcacgatagattttacggttgaaggacacttcaagaattcgggctacttttgggttgggtagtcagagcttgcagtgcccttttttaggaggtttttaatggattacgttggtagtttagcgttgattttaattgttacggcggttgcgggtcacctgagtgtccgaatgggcctacccgcggtgattggccaattgttaagtggaattatacttggtccagccgtattaggttgggtctcagcaacaagttttatcaaagacttcgcggagcttggcgtgattattttaatgttcatggccggcttagagagcgatttaaaattgctgaagaagtattggcgtcctagtttgttagttgcggtcctgggggtcattctacccgttgcggtgattgactggtgtagccaactatttcaccttaacgccactgaaagtttgttcttgggcgtaaccttcgcggccacatcggtttcgatttcagtcgcggttctcaaagagttaggcgccctcgatggtaaagaagggacgacgattttaggtgcagcggtcgttgatgacgtcctggctgttttaattctgagtttgatgatcagcttatttggcagtgaagtcagtggtggcggtagtcatgcctcaaccaacttgggactctcgctggcgattcagttggcgttctttgtggcgctgtactttgtggtcaagtgggtggtgccacatttaatggccgtggggaatgccctactggttccaacctccatcacgctgatgtcactagtgatttgttttggactctcatacttagcggacgcaatcggtttaagtgctgtgattggcgcgttctttgccggtatcgccgttggtcagacggactatcatgaagttatcgatgagcatattcaacccattggtaatgctgtatttatcccagtctttttcgttagtattgggctgaatatgtcattcaatggtttcctgaacgatttttggttcatcgctgtgattaccgttgcggcaattgccactaagctcattggtgccggggtcggcgcacggttggcgggttttaattggttaagcggctatgagattggcgccggcatggtgtcacgtggggagatggccctgatcattgcacagattggttatcaaggcaaattactatcagctgatcgttattcggcagtcatcacggcaatcattttaacgacgctgattgcaccactattacttcgtcaggcggttaaacgccaacgtgaagcttaaagcaattgaaaatcccaacttgtttgcgtgttgcaaacgggctgggattttttaatcacgacattattcagttgttaaacgttgatagtggacttcggcgagctgaccatatcgattggtgtcaactaattcaaagcgctgttgctggtcaattgctttaaataagggaataccatcacccaaaatgactggtgcaatctggatgtagagctcatcaactaaatccgcagctaacagcggcattaagacgccagcaccgccaacaatccaaatatttttgccagcggtacggcgcaagtcttcgacgatcttcgtgacgggggtattggtgaactgggtgcgttcatcgccggtgtgggggtgggaagtcatgacaatattgtgggtcgccggattatatggattaatgagttgatcagtggtttgttccatcgtgtattcgtaagtatggcggcccatgatggcggtatcaacttgctgcataaatgcttcggtgggggcatcgttggcaccagctgttttgaacagccagtccagccgattatccttagtggctaaacaaccgtcaattgaaatggccccataaaactgaactttacgcatgattcgacacctactttatctttagtagtcatattgtaccatgttttccggtcattcacttgctgaactccggtaaaagttcagtaacataattaaataattggttcgaaatgggaggtgggaaactacttaaggtgtcgctgggagcgtgtgaatgctgcaaataatgatgttgtggggctaatgagaatgagtatccacagcgggttgagcaggtcgtggtgatcattgtcggagaagtagcatacgggcaatcaagatgtgagttgaagtaacgattggtggttttcaagggccccaccgtccgctataattggattagcatttcatcacatacagtttgacctaattaggcgagctggcctggttcgtaaacttcccaggataaaaaaccaagaacttcagttatcggaggtaagagaatgaatgcgacgcgtaacgttattattgactgtgatcccgggatcgatgatagtttagcactattattggcgcttaaatcaccggcacttaatgtgattgggattacaattgtttgtgggaacgtgccaacccatatcggtgcggaaaatgcactgaaaattttagatttggctgaccgattggatattccagtctatttgggcgctaatcgcccattggaagtcgcctacacgagtgcgcaagacacccacggcgatgatggcttagggaatagtcagattccagcggtaacggcggtacgaccgattcaagatgccgctggttttattgaagagacgctgattgaagcacctgatacttcgattttagcgttgggaccgttgacgaacattgcaacggtactgcaacgtgatccacacttatttgaacaagtcgatcaatttacactgatgggtggaagttatcggagtcacggtaattgttcgccagtggctgaatacaacttctggtgtgacccggatgcggccaaggtcgtctttgacttgatgcctgttcccattcagatggttggtttagacgtcacgcgtaacatcgtgttgacacccagtttattaacgtatattaaagacgtcaatccagcaatgggggcttttgttgagaaaattacaaccttttattttgactttcattggaaatatgaacgggttattggttgtgtgatcaatgatccgttggccgtggccggaatgcttgacccaacgattctgagtggctttgaaagctacacgacggttgtgacggatggtgtcgcgcgtgggcagtcaatcgtggatgatcatgatttctggcacaacacacccaatagtcaaatcatgacgaaggttgacgtcgtagctttttggcggttgttcttaacgactgtggtcggtgcggctgatcctgatttaacgcaagtcttgcaccaattggtgagtgcatgaagagaataaagacgcgggcaattacgttattggcgctctgcattgccctgaatattgttggcagtaacattgccttgatgttaaaattaccgatttatttagattcaattggtaccgttttggctgctgctgtgtttggaccactgggtgggatgttggccgggggtgccaccggagttatcgtgggtgcgacgacagacctgtactcgctgttctttatgcccgttcaactgctgactgggttagttgctggtctgctatatcggcgaatcaagccgggcacgtggcggtcaaattggtggttagctggtgttatttcacttcccggaacacttttatccacggcgattacggtcatcttatttcatggcatcacgtcgtctggttcgagcatgctagtccaattattattaggtaccggtatgggcaaaacgatggccgtcttcttgatacaagtgggaacggattatctagatcggtttatcacggtgtacgtggtcgcacttgtttaccgcgcgttgcgatataaattgccgcaagctaattagtcgaacggatgacttggtgtcggatgaccaatctaagcatgtttacgctaactcgcactttttccagcgggccgaagctggctgtctttgagcttggcaaattctagttttcgattcgtagtatctgatgagtcgtgtgaatatgaacagtaaaaatgacctcacaggaacattcctggcgaggtcatttttactgttatgaggttaaagtgcagtggtcagtagcactacgagtcgcggcgactcatcttaccatcttcaatttgatagaccacgtcacagtcatcaatcagccgttggtcatgggtcaccattacgatggccttttggtgctgatgagcttcgttggcgaggcgcttgacgacgtcgatggagcggggcgtgtccaggctagcggtcggttcatctgcaagaatgacgcttggatcattgtaaagagcgcgggcgatggcaacacgttggcgttcaccaccggagaggtcacttgggtaggcatcccgaacttcagtaagggctaactctgctagtaattcatcggtgcctgcttgatcaaatttgcgccgggccattttatcgacgagcttgaactgttcacgaaccgtcaggaatggaatcagattggaactctgcaagataaagccaatttcattgaaacggtaggctaagcgctgtttttccgtttgattcgatagtggttgtccgttcagaataacttgaccacttgttggcgtttgtaaaccggcagcaatcgtcaaaaaggtggatttacccgagccagaggggccgataatcgcgacgaattggccagcactgacttcgaaattggcatcagtcaaagcgttaacagcggtatgaccgtgaccaaattgtttattaatattttgtaaggctaaaactggttgactcattgatatcatcctccttatccaatggcaacgacggggtcaatcttggcgacagtccgccatgagagtaaggcaccgacgactgcagctaacaagagagccacactataaataccaaattgtggccagtcaatggcgaatggtaatccggcgggcatgatttgcgcgaggcctaacgtaattagaaggccgatgccgataccaatgattgccatgacgacactttgggtgagtagggcagccaagatgtgtttggtaccaataccttgtacttttaagaccccgaacaaggcttgtttttgaagggtcagaacgaacatgaaaattccaatcacggctagggcaattgcgaacaagaagtaaatcatcgtgttgagtgtcaactgctcagcgctgtatcctggtaatttttcaataaacgtggcaattgataaacgttgcatgttgccatgatgttgagtcttgaaatgactctttttagtcacaaaggcgttgaccggttgttgatcgccactggtgatgggattacctttgagacgattgagcgtggcaacgtccgtgtagaccgttggcgcaatactataggtactagctttgaaagtaccgacgatcgttaccttttgatcagtggtcccaatgcgaactttctgaccaatccgatagcctttgtcttttaatcccgcggaaatcaataattgattcttgccgttgattcggtgtcctgagatgacttttggcatcagaaaactatcgcgagtggtaccaaaagcgctagcgttagttttttgaccattactggcagttcgtaaagtaccggacagactagctaagggtgcgacgtcctgacctttgattcgatcttggtctgctagttttaattgggatgctgacagtgtctgattcgcatcttcgttcaaataaactgtttgagcatgccactggtcaacagcctgacgattaccattggataacccgttagcaaggcccgctaacataaagacgacgagggcaattagtagcaaaaccccgctaagtagcccatatctgagtttttcgtgggccatttcttttaagcctaaatacatgtcaattcctcccttttaatttcatttatcaagtgataaatcaatgtggtaatcgtatcacgttcatttttgtaaatcaaattttttatttaattaccaggctaaattatttcgaaatgggtaccaaggctggtatgattaatttattgaatagagaggcaggtaattattaatggtgaacaagcagttcaatcatcgggccgcagttattgctggtgtgactggtggtgtgatttctggtttagttaagttagggtgggagaatatcctaccgccacgaacgccacagcgggatcaaacgaatcccccacaacaattattgcaacaaattgggattcccgccagcgttacgcatgcaacgtattcatattctggtcatgatttaccaggtgtcagctatgtcatgcatttcggattctcaacgacgtttgctgtggcctatagtttatgggctcgcaagcacccccgggcaaaaggtggcagcagcgcgttgtatgggttaggtatctggacagcctttcaccatggtatcttgccagcactggggaccgttcccgctgcgaaggatcaaccaatgaccgaacacgtgtcagaagccattgggcatgttttatggatgtggaccgctgattgggttagtgccgctgtctatgaccggatgacccgttccaaatagcggtttaaatcggttagtgagtgacgacatgatgaggtgttgtagccgcagccgttgaataaagttgttgcttgaaaaactagcttggttaggaatgattacaactgctaaccaagctagttttaattgtcgctattttggttaatgttcggattctgatggtaacggaaatagtgattcaccgcgacaattacgtgattatgaggaaagcaactgagattaacgtctattacaatgggaccatttgattttaatgattgattttttaatttaattctcatattgactgaaaatgtgctaaaatattaatattgtgtgcaatatttcataaaaacatccataaatgagaatggggcggaagtagcttggaaaagcagggaaagatgaagcggtatcgccagttccgattgagcttgggctggcagatcttaattgggctagtgcttggaattgtattaggggtcgtcttttatggcaataaaacggcgattactgcgatgcaaaacatcgggacgatgttcatcagtctgattcaaatgatcgttttaccaatcgtggtggcatgtctgattaccgggattgctaatatgggcgacctcaaaaagttaggtcggattggtggtaaaaccattatctatttcgaaatcatgacgacgattgcgatcgccttagggttgttaatgggtaacatttttcaccctggtgactatatcgatattcatcaactacatgcgtcgaatattagtcagtatgtgcaaaccgctaagacggtctcacacaatggtatttggtcgacggtcatgggtattatcccgactaacgtctttaaatcattgtcagctggtgacatgattccagtcatcttttttgccgttttctttggtttagggacggcggctattggcgaacaaggcaaaattattctggactttatgaacgctgtcgccgaagctatgttcaaagtgacgaactgggtcatgcacacggctccgattggcgtctgtgccttaattggggtcacggtcgctgaaatgggcttgaaggcgctggccccgttaggctatttcattattcttgcttatattaccatggcaatctttattgtggttgtgatgggcattgttggtaagttattcggtttaaatatttggcacctactacgggtcattcgtgatgaaatggtgcttggcttttcaacggcgagttctgaagcggccctgccccgcattatcgataagatggggaaatacggtgttagtgaaggaattgtctcatttgtgatcccaactgggtatacgtttaacttggatggctccgcaatttatcaatcgttagcggcgcttttcttagctcaggcttatgggattcacctgtcactcagccagcagatcactttattgattgtacttatgattacgtcaaaggggattgctggtgtgccgggggcttcgtttgttgtcttattggcgacgatttcaacgattggcgtgccagtacaaggactcgcttttattgcgggaatcgaccggctagttgacatgggacgaaccgtggttaacgtggtcggcaattcattagctgcggtaattatcggtaagtcagaacatgaatttgatacggccaaaagtgatcagtatttagctgagattcgggcggggcatgcgcgcgcaattacgaaataattgaaaacagctctgtcagttagttctgcattaataatgcgatggcgatgatcactgatgattgataggcccaaaagttgtatttcagaaattaatttctgaaatgcaactttttttatgatatcttattctggttacagcaattacttcagcgattaagttatgataagacctataggggaggatggcgatcggatgacaactgatttttcgattgggcaactcgcacagttatttgatatcccagtggcgactttacgctattatgacgagattgggttattgacgccggcacgagtcaatccgcatagtcactaccgatattatgggacgcctcagttcgaacggttgagtaccattaaatatttgcgagcactcggcttaccattggctacgattgccgatttttttgcggcccgtgaactgtccaagctgacgagtatgttaacgacccaacagcagcaggttgaggcgcaattgcgattattaacggcggtacaacaacggatcaatacacgcttggcccagattaaaacggcccaaagtgccaattttgatgtgactgaatgcgtgacgttacctgaaagagcgatggtggctttacgtcagccttatcgccctcaagatgatattgaacttgttattgctaagctacgcgcacagaccggcgcgacgaacgaaatctttctcggcaaggttgcgctgatgctcgaccagcaagccatccaagccggacattttgaccgctatgcgggaatttgtttattatttgaaccgggtgatacggtgccaccccatcaagaacacttggcggctggtagctatgcgcagcggatttttcacggcactcatttggatgccccgatgcagtatcgacaattgttagcggattgtcgtgctcgcggctggcacgtggcgggaacagctattgagacagcactgattgattatgggattacagatcaggttgcacagtcggtgacgcagatacaattaccaatcaagacttgaccctcaagtaactttagactttatactaaatgataattaattattttaaattgaaataagcgctagagattaagctattgattaggagtggcgatatgattggaacgatttttaatacgagcatgattttagctggttgcttggtcggcagtatctttaaaaaaggaatcaagccagcttaccatgcgatattattacaagcgttagggctagcggcttgtgtcatcggcattaatgcggtcgtgcaacggatgccgcagagtaagtacccggtgctttttattgtgagcttggcgattggtggattaattggtcaagctttggatattcaagggcattttgaccgctgggtgggccgtttggcgggtggcaacttagcggaaggcctagcgactgcggtgttactgtactgtattggatcgttatcgattttggggccgattgaggcagccttaaagcatgattacacctttttgtttacgaatggcatgttagatggcatcacgtcgatcgtattagcatccactttcggatttggcatcgcgattgcggcgggcgtcttgttttgttggcaggggagcctgtatgttttagcattaattttgaaaggtgcgttgagtgcagcgttactgaatgaaattaccattgttggtggtatcttgattctagcatccggcttaggtatgttgaaaatcaagcaattcagtacgttgaacctattaccagccttgctagtgccaccaatcgtaattagcgtgatgcaattattttaactagtgggccaatggtgaagtcaattgagtcttttgattgataaagtaaaagccaccaatttaggacaatcagtgaaagctgatcattttaagttggtggctttgtgtataatgcatcgatttgagagattggcattaaatatggttaaaacggactgttttttaaatcaaaagcaaccagcttaggcccgctggaaaaaagtcgagtaagcgtaaaattgcttagttggcgcgtcctacaccgacttccaggcatttcggccaattgctggaacgcggtggacacagatttaagccgcaaaccacgtcttaaatactggtcttccactaaccaagccaaggacgcttgctaagtggaatttcaccgctgagcattggccgaaatgccttccagtcgggatagtgttcgaatggcggacaaagatgtacctaagcttttgatgaattcgtcgttgcttttcataaacgataattttgttaatcaactgtcagactgaaagtgatattgagatagctcactaatcctgaattggtgtagtaagatgtaatctctcgacaaagtgctaatgcacctaacactttgtttgaagttccagtatcaaaatagccaacgatagattgtgctaagttcggtggtcgttcatcagccattcgagcggcttcaacccgtggcccctcacaggcttgagactggaggggctgggtgacaatgctcagtagccaaattattcttagctggaagtgggttgcttccggcttagaataagactcgtatttgagatgacgcgggttgggcgttagctcaaatcgacgtcggctgcgttccagcaattgtcacccagccccggaggtcggcataggacgcgcaccggctgacggaaaataatgcagttaaacagtttgttttaaccataattcatgtcaacacgcacaatagatgtcaaagtaagacactggttagattaagtggtgtttgatgctgaagagttgacgattgcgttccagatgacggtgaatgtgatcgatgaggacgtcgtgcgaccaatcggtagttgtgttaagtggcggaacgggaaaacgttcatcgatatcgattgtcggtggcgtgatggcacagttggcgactagggcgatggcgaggctcgtaggtgtgtgctggtacatgaggtcatttcgaatcgcaaacctgatgtgctgctggttggctagtttaacgtagcgattcaggatgtcttcatctagcaagccatgtaggagtagctggtaatcaggatgggccgccatttcactttttagttcggttgagtagtcacgcatgagtgcttgggtgaaagtaatgcccacatcgattcgttcgtgaaacgtgccaaggttacggtgttgttcatccggatgtagtacgggggccccgaatattgcggattgtaagtgtttatccatttggtcttcagaattagccatgccagtcaggtcctttcacaattaaccataaaatttaactgcttttactactattgtaataaagaaagcgctttaatcaacataaaattttctaaagctgatcagaagttaaaactttggatgccactaggcttgaaacggatgacagataatctaaggacgcaacggatttgccggggccaatttaatgctgttttgaaaacaaggactcagtgcttcataaaataacgaaggtgcccagaattaggaaaattgacttcatcggcaaataacgaatattcaaggccattttgggaaaagccagcctcggccagataatctcaattataatctaagtaacggtcagggctaattcaacaaattgataataaggttactaatatatcaataaactgattaaagcagtgtgctgcttaatgattaaccaggctaaccttaatccttgtcagcattgacttacggctgattatacaagccttttttttaagattgtaaaggtgtattattgattcgtccatggtatgatactacatagtatgttaggaaagtagtcaatcaaattaaaagagaaacggatggtaacaaatgccaagacatttacggaaacggcgccggtcctggacgctgatcataattgccatggtgcttttgggggtcattggatttacaagcacacaagtttctgactggattgatgcatcgtttacaactaaacaaacggatgcagctaagtctagttcccaaacgaagcccaagtcggtcaatcaggtcaagttggacgtcccgctagtgaatcaaatgacaacaccacgtttatacaatggttgtgaagtcacatcgttaacgatgttgatgaattacgcgcatatcaatgtcactaaaaatgaattagcggcaaagattacgagtgtgccactcacttatagtgacggcgaacatgggaatccagagtatgggtttgttggggatattactggtaacgatcctgggttaggtgtctatcataagccaatctataaattggcgaaaactgagactagtcaggtgaaggacttaacgggggcaaactttgatactgtgattgaacagttagaacaaggacggcccgtttggacaattacgacggcttcgtttgcaccggtcagcacgatgcaaacttggcagacaccacagggctccgttaaagtgacttatgatatgcacagcgtggtcattgttggctttaaccggactaaaaagttgatttatattaacaatccgtacggagaaaaacagcaggcagtcagctggaagaattttgaggctgcttataatcagatgggcaagcaagccattgttctgacgttaccacattagttagttaacaacatgctattgtgaaccaattagtttaagcaactaatcttggtcaagatgagccaaaatcttgatgagggttagttgtttttttgtggcggtattttcgaatgaaacggttgtaatatcccgtggtatgggtagttcgggcaccggaaagcgggtgagaaactgctaacaatatcatgattgtaaccaaactgtaattcaaatatcagcctttccagagttgttcataatattaaccataaaggggcgacgctttgttaacaagctgtaactgaattgaaatcgaattgacgccccagcccattaaaaatggcctattattggtagtataagaatgttaaagttatgggtatgtcataaactgtccttgatagtttagttgttggtgattgtgggaatcaccaacaacttatgatgataatttttttaattgcggagcacagtatggggagagggaccgcatgatggggattaaaaggctcagttggttagttggaacggcggtggtcgccacacttggcaggcaaattacggttcaagcacagggacacgcggtggtcgatatttccgagtggcaaggacagctcagcccaagtcaggtgcaggcgatgaagtcgcaagtgctatttgtgatcaatcgtcgtcagtatggtttaaattatgttgaccgggacgcagcgaataatacggcattatatgttcgttatgggattccatttggtgagtatgatttttcgcaatttacggatgccgctagcgcgcgccgtgaagcccaagcgttttatgcgcgctccaataaagctgcgcgtttttatgctttggattttgaagttaatacggtacgttcaggatcaactaatgcggcagttgcggcttggtattgtgaaatgcgcgcattgactaacaaaaaactgatcttctattcgtatgcttcgttcgcactgacgtatgccaaccaagcgcggcaacggtttgatgcccagtggattggtgcgctaacgcctaacccaccaatcatttcggcggcattatggcagtataccaatcgctatcatttagctgggctagcggcaccggttgataatagtcgggtcattactagtgttcatcccgtttcgtggtggttggggacgacccgtggcacacccggtgttgcgattaaagctcaaccaagactgaaagttgtgcacgatcgccatttgactatgccggcccacaatcaacagcatggacgggcgggccaagcagttgtcgccattaagaggccagcagttcagccagctgtgaagactcggccggtgcagcagaaagtggtaagcaataagtcgcgttcgcagaccgtggcgcgcgtcaaacggcggtcattgcaaacgatcagtgttaacagccatcatggcaaaataactcagcatcgcgccattcgacgccgagcgactcagcccaaagtgataaaacttaaagcgacgcgacgtacaggaacacagtttaaactgaatacgtccaaagcaactaaacttcggcggcccggtaagagtattcgaacaaaaccggtgactcgttcaaaagggcgaacgcggcagcgacttacgcgacgtcaaccgtcactgaggcagcgagtaacgaaaaacaggcaatcccgccgccgcgcactacgagtaacggtgcagcggcgagggtcgacgattcgtcgtgcaccacgtcggcaacgaacacaaatacgtcccgtacataacacttctcgggacaagcgaggacttagctgattgcatggctgtcgctcagttctcattatcatggtagaaaaggtaattatggttaagtaaaatcggtcatttgttgtagaaattaggaggatatttttcatgaactttaagcgcaaaattcaattaggaatcgccactgcaactgggatgttggtggtcggaattgttgccgtaccttcagtaacgaatgtattacacgcggcttcagacagtgttagtttggttagtcagacggcagcgcctacgaccgtcaaggcaaccaatcaaacagtcaaggccatcagtgcaagtgggaccaagggaaactaccgggtgaagtacgccaaagctgggactagttcgacgactgcgacgtatcaacagacgaactacaatacgaaaagtgatgccagcagccaagtcgattacttagcgaatacgcagggtcagcgtacgacacttaattcaggtacagcggcaacggttcaagggacgatgggcaaagtgtatgttcattggaacacgggtagttggtcagtgacaacgattgccaatacacaggacgttgctggtaatccaaccaagtttgctaatcaggtcaataatcagattcaaaagcaagatttgacgagtaaaaatgtcacgagtggtgccgttaccgtgtacgataccccacaaaacggacaggcaaactcagttcaatggcaaaatggcaaacaggttgctaaggttcaaggccagcaagccaataccgttatcaaaattgcggcggatgctaaagattaagtttttacctgggagctcaataaatgagtgccagtagtctggttatatcactgtgtcgacgtcaaccgcattcacaagccagacactatggttagattagtgggtttaatgcgatgttttgaccgaaaataggattgacttttggcagtggagtgcttatgatgttaggtaataattaaaaagtagtgatcgttaattagtagtcgttgacccaacagtctagcgactcggtgggtggtgcgaaccgagctgtggtcaaagatgaattacataacgtgaactgccattggccggatgatatccgttactaatcaatgagcgatcacatttggtgataacttgggtggtaacgcggaaaactcgtccctgttttgatgacaggggcgagtttttttgtccagcgacaataacgaggaggactaacatgaacattatcgatgatttaaaatggcgtggtgccattaaccaacaaacggatgaggccgggttaaaggaacttaccgaaaaccaatcagtctcactatactgtgggattgatccaaccggggatagtatgcatattgggcatttgattcctttcatgattctcaaacgattccaattggctggtcatcatccctacgttgtagttggtggtgggacgggtgctatcggtgatccatctggtaagaactcagaacgtaagttacagaccatggatcaagtgaagcataatcaggatggcttaagtgctcagatgtacaagttgtttggtcatgacgaaaacttttcgattgtgaataactacgattggttatcaaaaatttcattactagatttcttacgcgattatggtaagttgttcagtgtgaacacgatgctgaacaaggaagttgttgcaagccggttggaagtgggcatttcatacactgaattcacataccaaatcttacaatcagttgacttcttacacttgtaccgtgctgaacatgtgcaactccagattggtggggctgatcagtggggcaatatcaccgcggggaccgatttgatccaccgcttagaaggcaatgacgctaaggcttacggattaacaattccattattgttgaaggcggatgggactaagtttggtaagactgctggtggggccgtatggttaaaccctgaacggacatcaccgtatgaattctatcaattctggatcaaccaggatgatcgagacgtcgtcaaatacctcaagtacttcacgttcttaagtcatgaagaaatcgatcgattggccgaaacggtgaagactgcacctgaaaaacgggaagcacaacggcgcttagctgaagaagtcacggaatttgttcatggcaagcaggcggtagttgaagctgaaaatattactaaggcgttgtttactggtgatgttcaaagtttaacggcggacgaaattgaacaaggtttcaagggtgtgccatcagcagacgtctcagctgaaaagcaaaacattgtcttgtggctggttgatgctacgaaattcgaaccttctcggcgtcaagcacgtgaagatattaaaaacggtgcgattcgaatcaatggtgaaaaggtgacggatgtcgaggccgagattgatccgtccgcagcctttaatggtaaatttgtcattgtacgtcgtggtaagaaacgttacttcttggcacatgttaagtaagttaatttagcaggtggactggacccgttgtggcccagtctttttattattattacaagtaagaactggtgtaaaatttatttaggtcacattaataatgtgtgatcattgccagatgaaaatcaattgaggagatgaaagttttggtgggggttaaatttaatacacggacgattgcaatcctggggatgttgatcgcacttaatgttgttatttctatctttttccatatcccaatcccgatgacacacggttatattaacttatgtgatgcgggaatctttattgcagcactgatttttggctggcgtggtggggtcattgttggcggtgctagcggactattactagatttattgctagggtatccacagtatatgtttttctcactactcgttcatggtttagagggcggaatagcaggatatcttggtgctagcaaatcacatggtcgacagattgcagcgataattactgcggtagtggtgatggtggtcggatactttttgtcagattcgctgttgtatacgatggcaactggattggttggtgtaccgactaatttagttcaagctgtggttggtggtatcttggcattcccaattgttgcgggaattcgaccaatcgttaaacgtcatttgaatttttaaaattagatgtgctggcttaagataagcgttcgtcgtgcttttacgggcgcttttttgctgtctaaagggaatccttaaattggaaaacatagtgccatctcacaatgatgttaatcgatgacatataatgtagtaattgtgtaattgacgacagttttgtgccgttcttttcataaaagtgaaaaaacattggattaattgttgacagtttcataactggctggtatattagtaaacgttgctgctacggcagatgcatctcaccaccaaataattattgaaattagttgttgacaatttcttcagtaattggtaagatagtttctgttgtcgcaacggcaactatga

SEQ ID NO: 742 - DNA, 55861 bp, Unknown
  Metagenome-assembled genome
gccacaggaagctcccgatgcctgcatggagctcctccgacgagatgtgcctcatgcatgtcccgctctccggcatcgcagccacggccacggtccagccgaagcttcctgcgagcttgcctaagccgtttacagttcagggagcctaactatgccggaggtactcagccattttcccggatatctacagctgtgtcgagaagatacagcaataccttgctgatacctacggatggagctgctcgaacgaggagctgctctatctcatgatgcacgtgaaccgtcttgtgacggctcgctagccgcatatccggacgtgggaggacgcgtcccgatatagcacgtatgggggaagccaaaggtcttaaggaggaacctatggcagaaggaaagtacgactatctggccgaacagatcctggagaatgtaggagggaaggacaacatccgctctgtcgcgcactgcatcacgcgtctgcgcctcaagctcaaggatgtcgacaaggcccagaccgatgttatcgagaagcttccgggcgtcatcaaggtcatgaacgccaacggccagtaccaggtcgtcctcggcaacaaggtcgaggatgtctatgacgcattcctcaagatctcgggcctgaccggcgccggcgaagtcgctgccgacgacgatggggaaggcgaagagaagacggtcctgtcggtgatcgtcgacctgatctctggcatcttcgcgccgatgctcggcaccttcgccgctgccggcatcatgaagggcatccttgcctgctgcacggcattcgatcctgcctttgcggcctcgggcgcctatacgctgctctataccgtggctgacggcatgttctacttcctgccggtcgtccttggctacacggccgccaagaagttcaagatgagcgagttcaatggcctcgctatcgcctttgcgctcgtctacccgacgatggtcgcgctcacgaagggcgagatcctgggttcggtcgacctcggcgtcttcggtaccttctcctggtacgccaccttcttcggcctgccgatcatcatgccggcctctggctatacctcgtcggtcatcccgatccttctgatggtctggttcggctctgtggtcgagcactgggtcaagaagtggatgcctgcctccctcaagatgttcttcacgccgctcatcgtcgtcaccgtctcggtcgtcgtaggctatctggtgatcggcccggtcgctaccctgctcacgaacctgctctccgccttcttccagctgatcttcggccttccggtcgtcggctcgattgtcggctgcgttgtggtctccgccttctggatggtccttgtcatcttcggcttccactggtcgctcgtgcctatcgccctggtcaacctcacgacgctcggccatgacttcatccttgcttccgtgatcggccactccttctcgctcggcgccgtcgtctttgcgatgtatctcaagaacagggacgagaacttccgcgagattgcgcttcctgccatgatctctgccttcttcttcggcgttaccgagccggccatctacggcgtcgcgcttcccgacaagcgtgccttcgtgaatgcctgcatcggctctgctgtgggcggcctcatcatcggcatctcgggtgctgtcgtctacatctccggcggcctcggcgtcttcaactggctctcctacatcgatccttccggcaccatgggcgtgacctacatgatctgggccatcgtcgcctcgattgcatccgcgatcgtgggatttgccctcgagtttgcgtcctacaagcccgaagcttccaaggcatagcttcgcagggcgtacgcgttcatcatctgatagctgaatcggaggggtctggtcatccaggcccctcctttggaaaggggaagagatggcatttccgaagaactttctctggggcggcgcgactgcagccaaccaggtcgagggcggatacctcgagggaggcaagggcctcaatgtccctgacatcatgaccggcggtacggtctcgacgccacgcacggtcacgccggcaggcgtgaagccgggcgtcttctatccaagccacgaggcagtggacttctaccaccactacaaggaagacatcgcgctcttcggcgagatgggcttcaagtgctaccgtatgtccatcaactgggcgcgcctcttcccgcgtggcgacgaggagaagcccaatcccgaaggcgtcgccttctacaagagcgtctttgaagagtgcaggaagtacggcatcgagcccatggtgacgctgtcgcactatgagctgccgcttgccctttcccatgagtacggcggctggtcgaacaggaagctcatcgatttcttcgtgaactatgcgaagacctgcttcaccgagtacaagggccttgtacgctactggctcacgttcaacgagatcaactgcgcgatgatgggcggcttcggcaacatcatgggtctcggaatccttcctgaccatgactgggacgtgaacttcgccgactgcccgtgggacgatccgcagaagcgctacgagggcctccacaaccagttcgtggcatccgccaaggcagtgctcgcagcgcatgagatcgaccctgagaacaaggtcggctgcatgattgcaggaagcgcgaactatccctacagctgcaatccggacgatgtgctcgcggcgcacgatgcgatggacaagagcaacttctactgcggcgatgtccaggtgaggggcagctacccctgctgggcaccggagctctggaagaaggagggggtcgatctttccgcgcttgccaagaaggatgccgacatcctgaaggcgggcacggtcgacttctattccttcagctactacatgagctccacgacctcgatggagaagacggccaaggaaggcggcaacattttcggtggcgctggcaacccctacctcaagaagtccgactggggctgggccatcgatcctgagggcctgcgctactacctcgagtgcgtctatgaccgctaccaggtaccgctcatgattgtcgagaacggcctcggcgccgtcgacaaggtggagccggatggctccatccacgatacgtaccgcatcgactatctcaggacccacatccaggagatggagaaggcgatcgagcacggcgtcgacctcatgggctacacgatgtggggctgcatcgacctggtgagcgcctcgaccggcgagatgaagaagcgctacggcttcatctatgtggacaaggacaacgaggggaagggctcgcttgcgcgctcccgcaaggattccttcttctggtacaagaaggtcatcgcaacgaatggaaatgacttaaactaggagtgccttcggcaagaggcgctgcagcctgcggcgcatatgcgatacaagggagtgcatcatgggattcttcgacaagttcaagaaggcggcaaagcccgccaagcctgaagcgctgggcgtctctgcgcctgcaggcaccgttcttgctccggttaccggcaaggccgtcaagctcgaggatgtgtccgacccggtcttcagctccggcgctatgggcaagggctgcggcatcgagcctgagggcgagtgcgtctacgcgccggtctccggcacccttacggcagcaggtgccccgaactaccatgctcttggcatccagggcgatgacggagcagaggtcctcatccatgtcggcgtcgacacggtcgagatgaagggcgagggcttcaaggtctacggcgagaagggcgctcatgtgaaggcaggcgagcctctgctttccttctccaaggacaagatcaaggctgctggccatgacactgtcgtcatcatggctctcacgaacaccgacgatcttgcttccgtcgagttcacgcacgagggtccggtcaaggcaggcgagccggtcatcagcttcaagaagtaggctgctgacgctcttgcgttgaagcatgggaggcgctccatctcgaggatggggcgcctcttcgtgtttgaaaaagacaagccacggagggccgctgtcctattcctcatctccgaaaaaatgcatctgctgatccatgaatgggatatagggatgcttcagtgaaaagaacaaatgttctattatagagaggtctgcaagatgatgccgaatatgacaccattctagggaaggaaggaccatataaaaatgggataagctgctgaaacgtgtgcaggctctttccggcaatttgaggtttgaggagctgtgcaaggtgccggaaacctgcggatatgaaatgtctcgaccgtcagatggaagcagccactgcatgttccggaagcccggcaggaatcccatcacgataccgcgtcatgtccccattaagatacagagaacttgtccgcgaagcagttgaggaggcaaggcgtgaagaagattgattactatttgaatctgccctacaggctggaaatcgttcccgaccccgatgaggggggatttgcagcgcgctatcctgatcttccgggatgcatcacatgcggtaacacgttggacgaggttgtacagaatgctgctgatgcaaaacgtgcttggctcgaggctgcgctggaagagggtgtggatatagctgagccgaagacggatgagagctattctggccagttcaagctccgcctcccgaagagcctccaccgctctcttgccgaacacgcaaaggctgaaggcgtcagcatgaatcaatactgcctctatctcctttccaagaacgacggagcggagtcaagtcgcttcgacaggaagagcattgtggcaggatagcttcttgcgacagccttgcgcggtcatgacagtacgtgtcaattcaaaggcagggcctgcagcgatgtggctgcaggccctgcccagttctttgtggctacgcgccttagtgatggaagaggcgcatgtgcgtgaagcacatggcaatgccgtacttgtcggcggtctcgatcacgttgtcgtcgcggatggagccgccaggctcgacgatgtaggagacgcctgacttgtgggcgcgctcgacgttgtcgccgaaggggaagaaggcgtcggagccaagcgtcacgccggtctgtgtggcaatccaggctgccttctctttgcgggtcaggacctcaggcttctcggcgaaccacttctgccactcgccgtcgcgcaggacatcgtcgtgctcgtcggagatgtagacatcgatcgtgttgtcgcggttcggacggcggataccgtctgcgaacttgaggccgagcaccttcggatgctggcgcagataccaggtatcggccttgttgccggcaaggcgcgtgcaatggacacggctctgctggccggcgccgacgccgatggcctggccgtccttcacatagcagacggagttcgactgcgtgtatttgagcgtgatgagggagatgaccatgtcgcgcttggcgtcgtcggggatgttcttgttctgcgtcacgacctcgttcagaaggtccgtcgagatctcgtagttgttgtggccctgctcgaacgtgatgccgaagacatccttctgctcgaccggtgcgcactcgtaattcggatcgatctggacgacgttgtacttgccgcccttcttggagcgcaggatctcgagcgcctcgtccgtatagcccggggcgatgataccgtcgctcacctcatgcttgaggtactgtgcggtgcgcttgtcgcagacatcggaaagtgctgcccagtctccgtaggagctcatgcggtcggcaccgcgggcgcggatataggcgcaggcaataggggtgagcgggccttcgtcatcgacgaagtagatctgcttttcgatatcggagagcggggtgcccacagcggcgcctgccgggctcacgtgcttgaaggaggcagcggacggcatgccggttgcacgcttgagctcgcggaccagctgccaggagttcagggcatcgaggaagttgatgtagccaggcttgccggagagcacggtcacgggcagatcggagccatccttcatgaagatgcgggcaggcttctggttggggttgcagccatacttgagttccagtgagttcatcgcttactctccttcgcgtgcattgaacaggcggatagtgccttcaacattcgtgtagaggctgaccttgttgtccttgttgagggctgcccagatctcgttaggctcgggcatcgtgacctttatcggctcgccggcaaagctcggaagtggattgccgtctccctgataggtgctgatgaaatagccggcaccttcttcgacgccttcatagacgaagaactcgcggcagcactcgtcggcttccgtctcggcatgcttcaggatggagattgcgaaggagccgtcggggtgcaggatggaggagatgcgcggcgtgaagttcgggccatcgggctcgaagcggcgcttcaggcagccgcggaagaagtctttctcttcgacgatcgtgtcggtctggtcgccgttcgtcacgacgaggtcttcgcccattgtgcggacagggtggtagatgataagcgagggatcttcaagcttcgaagggtcgtatgcctcggtgcggatgccgtcctccgtggatacgaagatgcggttcctgctgttttcggaacgtcccatgatccagtagtagacacgcttgtgtccgaccacgatgccgcggcctggatagggattgccttcgagcagttccagaagatcttgcatggtcttcctctctattcggcacagcccaaaggaggaaggcacatgagggcccgcgctccttcacgaagctgcgcatgcccagacggtcggcgaatgtatggcaacgctgcttccccgtggtaggcccacgttttatccgtcagtcacagcgcacgctctgtccaggacagcagctgctgccctgatgcatacgatagcacgagcaggagagctcggatggcctgttcgcccgagcttggaaaagatgcatgaagccatggggggtgccgaaggcagggccgaggtaaggactctatgtccaaacggagcagatgcacctcggaagagaagcttcctgctaccctttcagggaatgccgggatggacctggcaaggacggaatggagcaggcgtgggcaagcgcatagtgctggtaaacgatctctgcagctacgggaccgtatcgctgacggcaatggatgcagtcctttcgcgcatgggctatgcgacgagcctcgtgccgacggctctcgtctcgagcacgttcaaccgcgaggaagtggccgtgctcgaaaccggctcctatgtgcgcgatgccttttctgctctcgaccggctgggagtggaatttgcagccgtcgccacgggctacattgccaccgaggacgaagctcactccattgccgacttctgccgcaagaaggcagaggaaggtgcggccatcttcgtcgatcccatcatgggagacaacggttccctctaccacggtgtcgattctggaagcgtcgagcgtatgaggaagcttgtcgcgctgtccgactatgctgtgcccaacgcgacagaggcctgccttcttgccggcatggatccctcgaaagaggagctgacagagaaggaagcgaaagagctcgtggcacgcctgagagagcttggtgctgggtctcttgcaatcacgagctgccgcgtggaaggcgcggactgcgtgctcggatacgacaggaagcaggacaggatcttccgtcttgcgatcgactatatcccctgctactttgccggcaccggcgacatcttctcttccgtcatgctcggcaaggtccttgcgggtacgcccttcgaggaggcagtccgctctgcgatggatctcgtgcgcacgctcatctggcgccacaaggaccaggaagatgtattcctgggccttccgctcgaagaggagaacgagcttctcggcagcctggcatagaggcaatcccaggacatgccggctggcgtgcattgcatcaaaaagaaaagcatgaagaacggcaggcatattccagaaccatgcaagagggctccgcaccacgatgggctgcctttctcggaacgcaggcttctgtgccaggttctgtggtgcagttcatgaggtgcggagtccccagctgtttcggcggaagatatgctcagtcgtttccgaagcggccgcccgttgtcggatagccgtagaccgagccgtccttgatctggatctcgtcctcccagggcagatgatacttgcctgctgcgaggtccttgatataggtgaggccgcaatcgctctcgccgcctggctttgcgacatagccgcggtggccgaggttgtagatgttgttctcgagaccccaggtgcggcgggcattgtcagcaagctcggggtagatctcgccggtgacgatctcccagggattgcgctgcccctggacgagtgtcgtgccgtcgaagttgcagatctggccctcgccgaagtagtagaaggtgttgtcgtagcctgcgaggttgacagagaccgtgtacatgaggttctgccaggcattcgagcggttggtcaggatccactggtcattgacctgcgtgctgtagccggagatgcggatatagacattgcagcccttgtaggcagcttcgcgcgcaagctcggggatcatcccgtcatggcagatgcagaccgaaagcttggagccgccagggccttcgcagaccggcatgccgaggtctcctggataccagggctcgatggggttccaggggaagagcttgcggcatttgaggatgatgtttcccaaaggatcgatgatgattgcggtgttgtagggattcttgttcgggtcgggattgcgctccatgatggagaagacgccgtagacgccggcctcctggcaggctttcgagaaggcgtcggtctccggtccaggaatatcgcagaggaattcgtcggtcagccacttggaggtattcagcccctgcgtgctgtactcagggaacacgatgagctcgacgcccggatagccagccttggtggcatggaccgtgcgcacgatgcttgcgacctggcggtcgatatcttcccggctgttgacgaccggggccgggaactggactgccgcgacaagaaatccgagctttggcttgctcatgctgccgatagatcccatacattcctccgtccatagcccaaacctgccactcgatgcaaggactgacaagatatgcaataatatgcatattattggaagctgccgctggaggaaagagctgccgctccagcagcgggcctgtcattgcctgcatcgaatacgcctgaaatcgtagagctgaagtggtttgaaagcaatgaggaagacagggatatctgagtgtttacgggaataggcagaatcggaaaagccattgctacagatctgaaatatgagaaacaactgacagaatatgcattttctaccagataggccggggcagggaaggagcagggagacagcatgtgacggaaaagcggctgcatccgcaaagggatgcagccgctgcttcaaagcgcaaggaacagctcgtgcacggccaggttctcttcgagttcgggatggaaggcaaggccaagctgggctccctgcctgacagcgacaatgcggccgtccaccttggcgaggacctcgacgtccgggcctgcttgcttgatgtaaggcgcccgtatgaaggtcatgccgatctttcccagtcccttgaactcggcttcggtgcggaaacttccgagctggcgtccgtaggcattgcgcacgaccgtggcatcgagcgtgccgaagtggcgctcggggcgcgcggcgctccggtctgtgccatcctccacgtcgtcctcgatgtttctggccagaaggatgaggcctgcacaggttgcaagggtcggcatgccgtcctcgatgcgctcgcggagagggtccaagagcctctccttcctgaggagccttccctgcaccgtggattctcctcccggcaggatcaggcggtcgaagggacgcttgaggtctgcctcctcgcggatctcgaagaagggctctccgagcttctccagcttctgctcatgctcgatgaaggcgccctggagtgccagcactgctgtccccatcacttgccccgctctgccatgagaaggtcgatctcgtccttgttgatgccgaccatggcctcgccgaggtctcgggaaagataggcaagcttctcggggtcctgccaggctgtgacggcgccgacgatagcagctgcacgcttggcggggtttccgctcttgaagatgccagaacccacgaagacgccttctgcgccgagctccatcatgagggcagcatcggctggcgtggcgatgcctcctgcggcgaagttcacgacggggagctttcctgcatcatgcacgctcttcgcaagctcaaagggcacctcgagctgcttggcggcctcgaagagctcgtcttcccgaagggcttgaagctcatggatctccttctgcatctgacgcatgtggtgcacggcctgcacgacatctcctgtgcctggctcgcctttcgtgcggatcatcgaggcgccttcctggatacggcggagtgcttctcccaggttcttggcgccgcagacaaagggcaccgcgaacttcgtcttgtcgatgtggtagatgtcatcagcaggcgagagcacttcggattcgtcgatgtagtcgatatcgatggcctgaaggatccgtgcctctgcgatatgtccgatccggcattttgccatgaccgggatgcttacggccttctggatgccttcgatcatcgcagggtcgctcatgcgggagacgcctcctgcagccctgatgtctgccggtatcctctccagcgccatgactgcgcacgcccctgcatcctcggcgattctggcctgctcgggcgtcgtgacgtccatgatgacaccacccttgagcatctgcgcaagctcgcggttgagctttgcgcgctccggtcctgcttcctggttcttcgctcccatcgtgcatcctttctgctggcttcagtgcatgcaggcgaggataggggatatctggttctatgttcagaaccagaaactatataattggtaggaccagaacagggccagatcgagcttcaggacaggaccagacgatgctttcagtcgatctcacaaggcgcggcacgcttgggcgtgcggagtatctctaccgcgagatccgcgatgcaatcgtcgcgggcgagcttgcaccggacgagaagctgccctcgaagaggaggctcgccgagatgctcggctgctccctcatcaccgtggagtctgcgctcacgcagcttgcggcggaaggctacatcgaggcgcggccccggcgcggctactatgtcgagcggctgggaaagcttccggaggctacggcacaggcgctgtccaaggcagaggcgaagactctcccagagagggaacggctccgcatcgatacatcgcatctgccagcacgtcccgacagaagcgcgctgctcctctgggagaggagccttcgacatgtcctttcggcagaagacctcgacgaggcattctcttcgctcacgccacagggattgccgaggctccagcaggcgatagccacgcatctcgctcagacgcgcggcatgagggtggaggcagaccagattgtcgtggcagcaggcgcccaggtgctctaccagcttgtggcgcagctcctgccggcaggctccctctgtgccgtggaagacccgggattcccgcgcattgcaaggacctatgaggcagaagggaagagggcggtgccggtcccgctcgatgcagagggcatcgcaatggaaggaatcaggagcaaggatgtgcagctcgtgcacgcgatgccgtcgcaccagttcccgaccggccgtgtcatgagcatctcccggcgctatgagcttctgggctgggctgcggaggtgcctggccgcctcattgtcgaggatgattatgactgcgagttcaggctcgcaggaaggcccattcctgctcttgcaagcatcgacgcgacgggtgctgtcatctatatcggcacgttctcgaagagcctgggtccggtcgtgcgtgcagcctatgcagtgcttccgcctgcagcagcgcggcgctacgaggagctccggtcctttgcggcaggcacgctcggcacgatcgaccagctcgcactggctacgatgctcgaggacggaagctacgagagccatgtcgcacgctaccggaggctcgtgaaggagcgtcgtgaccatcttgcggaggcgcttgcacgggagctcggggagagcatgaagctcgaagaggcagactccggcctccatatggtgcttgcgctcaggcttcagcccgcatggtgcggacgcgaacaggaagcagaagaggcgcttgtggaagctgccagaaagtgcggcatagggcttgcagcgctctcctcgtatgcacagctgccgtatcgaggagacgggtctgcgcgcttcgtcctccagtacgagcggctcgaagatggagagatggaagagcttgccgcaagtctcggcacgcttgcgcgcaggacaggagtctgtggctgagggctattcccacgtcttccagacgtcgggtgcatagccgaccgtagcctggcggccgttcctcacgatcgggagcctgatgacctgctggttctcgaggaggaccccttcgagcatcgccttcggcgtgtgctgcacaagggccagggcatagccatctttgcaggcgggatcgatcagggcttcgaggccgcctgcggcacgggcgacggattcgagctcgcccttcgcgatgcccttctccttcatatcgatgtactggaagcggatgcggcgctccttgaaccagcgctctgccttctttgcgtcattgctcttcttcgtcccgaagatctggatgttcaccgcggcctcctctggaatattgttccatccatggtaggcgaaggcgggatgcggtggaaggaggggctgctgccgtgctggaaggctaccggttttcggggtacacctcctaaaacattcaaaaacagtcaccgaaaatgaagattagtgcttgaaagtgacggattttgggtgcatactgtcttcagcaaccagggagagggatgaaagatgctcgcgacagaacgccaggacctcatatgcaagctcgtggcggagcaggggagcgtcacgacccctgagctcatggcagcgctcgatgcatcagagtcgacggtgcgcagagatctcgataccctcatgcgccagcgcaaggtcgtgcgcgtgcacggtggtgcctgtgcgccgaagcgccatatggtcatccaggactcgccggtcgcgcagaagcgcatggtgaacctctctgcgaaggagaggatcgccgcctacgctgcgacgctcgtgaatccggaggacttcgtcttcatagatgcgggatcctcgacgatgatgcttgtcgattcgctgacggagacccatgcgacctatgtcacgaactcccttccccatgcccaggcgcttctggccaaaggcatgaagacgtatcttctgggcggcatggtgaagcccgtcacggaggcagtcgtcggggaggacgctatcgcctcgctcgagcgcctgcacttcacgctcggcttctggggcacgaatggcatctcgctttctgccggcttcacgacgcctgagctttccgaggccaaggtcaaggaagcgagcatcgcccatacgcagagcccctatgtgcttgcggatgcgacgaagttcgaccaggtctccctcatcacgtttgcagccttcgaccaggcttccatcatcacggaccatctcgatcccgagagtgcctatagcaatgcggagaacattgtggacctagaggaggagcgcccatgatctacaccgtcaccttcaatccgtcgattgactacattgtgcggatgcccaggctcgtgcctggagagatcaaccgtgtcacctatgaggatgtcctgccgggcggcaagggcatcaacgtgagcatcgtgctctcgaacctcggacacgcctcctgcgcgctcggcttcgttgccggcttcaccggacgcgagatcgagtcccgcatgcaggcctacggtgcgacgtgcgacttcatccaggtgaaggaaggcatgagccgcatcaacatgaagatcaaggcggaggaggagactgagatcaacggcatcggcccgaagatcgaggaggcagacatcgaggcgctctatgcaaagctcgatgccttgaaggctggcgacgtcctggtcattgcaggctctgttccttcgatgcttccgtccgatatgtacgaacgcatcatggagcgtctctccggccgcggcatcgagatcgtcgtcgacgctgagcgcgacctgctcgtgaaggtgctccagtaccatcccttcctcatcaagccgaacaaccacgagctcggcgccatcttcggcgtggagctcgagaagaggccggatgtcgtgccgtatgcaaggaagctccaggagatgggcgccaggaacgtcctcatctccatggcgggagaaggagccgtcctcgtgccggagaagggcgacgtcgtcgagagcgcagcgccgaagggcacggtcgtgaactccgtcggtgccggcgactccatggtcgcaggcttcattgcgggctacgaggagagcaagggcgactacgccacagccttccgcatgggcgtctgcacgggatctgcgagcgcattctcgccgaagcttgcaacgcgtccagaggtcgaggcactgctcaagaccctgtagccagacctgccggaaggcagccgagataggtagagcgtgccggcatcattgccggcgcttcaaggggcacttcatggtgcccagacaagagaggggagcaacgtgaagatcactgacttgctcaaacccgagggaatcaaggtgggcgccacggcgacaagccaggatgacgcaatcaaccagctgattgccctccaggatgcctcaggcaacatcaacgatacggttgcctacaagaaggccatccttgcccgcgaggccgagttctcgacggccgtgggcgacggcatcgccattcctcatgccaagaccgcagccgtgaagcgtccgggcctggcagcgatgacggtaccgggcggcgtggactggaatgcaccggacgatgcgccggcagacctcatgttcatgatcgcagctccggaaggccagaacaacgcgcacctcgagatgctcgccgagctctcaaagctcctgatgcaccaggagttcgcagacgccctgcgcgctgccaagacgccggaagagttcatgtccgtgatcgacggcgccgaggcaaagcgtgaggcagcagatgctgccaaggccgctcctgaggcagtggcagctgcaggataccctgaggtccttgccatcaccgcctgcccgaccggcattgcccacacctacatggcagccgagaacctggagaagaaggccaaggagatgggcatcacgctcaaggccgagacccagggctctgcaggcgccaagaacatcctgacggctgacgagatcgcccatgcaaagggcatcatcatcgctgcggacaagaatgtcgaccgtgcacgcttcggcggcaagcaggtcctctccacgaacgtctccgccggcatcaacgagccggagaagctcatccagaccatcctcgacggcaaggctcccatccaggaaggcacctcggtctccgcttccgagacgtcgggcgagaaggactccacctggcacgtgatctacaagcacctgatgaacggcgtcagccacatgctcccgttcgttatcggcggcggcatcctcacggccatcgccttcctcgtcgaccagccaggcctcggcactgctgcctacggctcctcgatcccggcagctgcgttcttcaagaccatcggcggcgaagccttcggcatgatgctgccaatccttgcaggcttcattgccatgtccatcgctgaccgtccgggccttgcccctggcttcgtcggcggcctctttgccaagaccggctacagcctcgcctacatcacgctcctgaactccgaccccaaggcggcagcggcttcgtgcatctccggcggcttcatcgcagcgctctttgccggctttgcggcaggatacatcgtcctcggcatcgagcgtctgtgcgaccatatgcccgactcgcttgaaggcatcaagccgatgctcatctatcctctgctcggcacgcttgcaatcggtgcggtcatgttcgtcctgaacccgctcttcggcgccatcaacaccggcctcaatgactggctgaacggcatgggcacgacgaacatcgtccttctcggcgctgttgtcggcggcatgatgtcgattgatatgggtggcccgttcaacaaggcagcttacgtcttcggcactggtgccctcacggccggcacgacctcgggtcagatcatcatggcttctgtcatggtcggcggcatggttcctcctctcgctatcgctctctccacgaccttcttcaagaacaagtggtccaaggccgatcgtgacgccggcatcgtgaactacatcatgggtctctccttcatcaccgaaggcgccattccgttcgcagcagcagaccccggccacgtgcttccgtcctgcatcatcggctctgccattgcaggcgccctctccgcagccttcggctgcacgagccccgctcctcacggcggtgcctgggtcattgccgtcatcggcaacccggtcggctacctgatcgccctcgtcgccggctccatcattgcctgcctcatcctctccctctggaagaagtcctaccagcaggaggcctaaaggtccaaggcacatatccgctccatcagggaagcagctcttcggggctgcttccctttttgcaatacaggcaatggggaatactggtcacagagacaaggaggagccatgggatttgtctggccgtggaagcggcagaagaaggtcaatcaggtgccggacgagatggcggcagcggcacatgcggcatctcttgcagaaggcacggatgcagagggtccgaagaggcgcctcgagcttcgctattccggcaaggtgcaggcggtgggcttccgcttccaggcacagatgcttgcgcagtctgtgggcgtcacgggctgggtcaagaacctcgacgacggagacgtgctcctcgaggtcgaagggacggcggcgcagctttctgcctacaagaaagggatagagaacctttcgcagagccgcaatacctggatcgatgccaggctcgtctcggagcgggaggtgccctgcgtgcacgacaccaagttccgcgtacaatactagggacttaagaatgccgggatagcatatccctcttcagaaaggcagctcatgatcaaggaactcgtgaaggacgaagccatcctctccaagccctgcgagacggcaacagcagaggatgcagcgctcgcacaggatctcgtggataccctcgattcgctcgaggatgcatcctgcctcgcagcaaaccagatcggcgtctcgaaggccgtctgcgcactgacggatgacaacgggcacgactatgtgttctacaatccgaagctcctcttcggcatccgtccctacaagaccgaggaaggctgcctcacgaaggatgcggtctcgaaggtcacgcgctaccagaagatccgcgtgagctaccaggagctcaaggacggcaagctcgtctccgagacccgtgattttgtgggctggtatgcgcagatgatccagcacatgatcgaccactgccagggaaagctcgtctagggaaacgcttttcgcgccgtttcgcaagacgcgatagaattgtccagatcgaagaatggcccatcagcacggcatccgcaccgaagctctggcacagggaggcatcatgcccagacaggaactcgtcacctatttctcggctaccggcactacagccaagctggctgcccgcatagctgggattcgtggctgcgaagcggtgcccatcctgccgaaggtgccctacagcatagccgacctgaactggggcgataccggatctcgaagctcgctcgagatgggcgacgattcctgccggcctgagctcgagcccctggagcgcaatcttgcggactacggcgtcatcttctgtggctatccgatctggtggggacaggagccccgtgtcatcgattcttttctcgagggcaatgacttcacgggcaagatcatcgtccccttcgcgacgagcggcggctcagatatgggatccagccctgcccgcatccaggcgctgacaccgggctcgacggtacgtggcgcacgtcttctttctgtggcgtttccggacgaggtgcttgagcgctggctcggcgagctgcagttcgaatagcggtacgtctgaagtccgatgcatgaagatgcaggaacgcccgtccggcagctggaccggacgggcgttcctgtcgaggatctcttcctgtagcgctcttccgctcagcagcaggaggctacgcagcggggcgcctctgccgtacatctgagctctccgaagaaggaggcaagcatccctgcttctgcaggatcgatcgaataatggcaccagcggccttcgcggcggcagctgacgagccctgtctggcagagcaccttcatgtggtgcgagagcgtggcctgcgtgatatcgagctgctcgaggagctcgcaggcacagatctcgccttcgtctgctattgactggacgattgcgagccggttctcgtccgcgagtgccttgaagacagcgagcatcctggcatccgctgcaacgcgctgctggcagagccgtctgctgagctcacggagatgctcggctatcctgtcagcgcactcctcatagccttcaggggctccgcccatagggtcttcgagctcccagtcttcgcggtgcgtgcagggaagcgcaggacagctgacgccgcagcccatcgtgacagcgatatcggccttgccgatggcagacaagggcttcggatggaggcctttggcagagatgcccctcctggcaagctctgcggcagctcccgggtctatcacaggcgctgggtcggtcccggcagagcagggctctgcccacgcgggcagaatctcgcgcgcaagcgcttctgccatctggctcctgcaggcattgtgcgtgcagatgaaggcaatcttcaccgtgcgtccgccctctttggccatgcaagcctcctttcgaacatgcgggcagcattgaccagcatgatcagcgtcggcacctcgatcaaaggaccgatgacggcagcgaacgcctcctcggatccaagcccgaaggtggctgcggcaacggcgatcgcaagctcgaagttgttgccggcggccgtgaaggcgaccgatacacagcgctcataggagaggccctgggcgtgggctgcgaagaaggagccgaagaacatcgctgcaaaatagattataagcgggatcgcaatgcgtacggcatcaagcggcagctcgacgatccgctgtcccttgagcgagaacatcaaaacgatcgttgccagaagggcggcaaaggatacgggcgagatgcggggaaggtattcctcctcataccaattcctgccatgcgtccgttcgagcacggcacgtcccagcgcacctgcggcaaaggggatgccgagatagagcaggatcgtccccgcgacatcggccatgccgagcgaaagctctgtgccgggaacgccgacaagccgggtgccttcggagaggaacagccatgctgccggcgcatagaacagaagctgcagcagcgcattgacagccacgaaccctgcgcacagatccacatctcctcccgcaagtccgttccagacgatgaccatagcgatgcagggggcgatgccgatgaggacgaggccgcgcatgtagccggggacatctctcaggaatgcggtggcaaggccaaacatcagcagcggccctatgatggcacagaacagcagcatgagcccgagtgccttccggtcatgcagcacctggggaaggcgcctcaggtctgcctttgccaggggcggatagagcatgagcatcatgcagatggcaagagggatgtttgtcgtgcccaccgagatggtgcccagggcatccgacaggccgggggccagcgcgccgagcgctatgcctcctgccattgcgaggaagatccataaggtgagatagcggtccttgaagctgagcttctgcacagcgctttccatggctagagagtcctttctccgggaattgtgggtatgcccgcaagctttccggccgcgagcttccgggcgcgttcgatccaggggagctcggaggcggcgcgtgcagccaggatggggtcacgtgtttccgagagcgagaggcatcgattggctatccaccagccatgcggcatgcgggcgcggtcaagatcgtgctgcaggcgctctgcttcccgcacgggcgtatcttcaggaagcgtgacgacgatcatctcggtctgggaagagtcgtgcagccggggcaggaggctgcgcacgctttcaggcaccttgccgcctgcgtgctcgatttgcctgccatagcttgctgccccctcaagcagaagcagcgtgtgtccggtaggcgccgtgtcgatcacgaccgtctcatgtgctgcgtgggagacgatctctgcgaaggcgcggaaggtggcgatttcctgtgtgcaggggcttctgaggtcctctgcgatgtaggccaggccttcgctgccgacagccttcctcgcttcggcgagcacctcttcctggtagcgtgcgagctctgctgcttcatcgatatgcgagacctcgagcccatctgtgctgaaggctcccagatggtctgccggatcggtcgtcgcgatgcgcacctgctctcctgcctcggcaagccgtctggcaatcgagacggcaagcgtcgtcttgccgacgccgcctttgcccatgacaaggataaggcgtatcctgcggcgtacaaggtctgccacaagctcgtcgagggaccgaagggcgggagcatccggcgcggatctctctggtacctgcgtgccgtctccagacagcagctcccgcagcatttctgttggccctacggcatcgaatggcctgagcggtactccgcgtaccggcatgccttccagggcttcgggaagagcggcgagcgcccgctgctggcttctctgcagctggcgtgcaaggtcgtcttccggatgctcgataagggcattcacgatgaggagctgcgctgcaatcccgacgccgcggagctcctgggccgtgcgggcggcttcgtcgaggcagagccctccgggcgtgcgacaagcacgagagcgcactgctgcggatccttcaggatgtccactgcgcgggcatagaggctgcgcttttcggaaagcctgaaagcgggcccaggcacgaggtgcctgtcgtattgctgtccagataggtgcaccatgcccctggcagctcgagcatcctcagcgtgtggccggtcggtgcggtgtcgaagatgatgtggtcgaagccttccgtttccgagccggcaagaagctcggcaaagcggtcgaaggcagcaatctcgacggtgcacgatccggagagctgttcttccatctgggcgattgcgtcggcaggaagcacgccgcgatacggcgcgacaacgctctcacgcagggcagctgcctcgcctcgggtccacctcttcaagccagagtccttccactccgtgtgccggcaccggcgtggcaccgacttcctgggagaatacgtcttccagattggaggcaggatcggtggtgaccagaaggacctttctgcctgcatccgccagggccactgccagggcacaggagatgccgtctctcccgacgcctcccttgccggtgaagaagagatagcgcagcggggcaaggtcgcgtgcttcgggcagctgccatctcatatcggccacccctagcagcaggagccgccgcagcagcagctatcggagtctccgctgcagcagcccccatcggagtctccgcagcagcacctgggaaccctcattgtcgtccgagacgaagatgacgccgagcgttgtgcccaggagctctgtcgtggggtaggcgcctttcgctatgagctcgccgtcgacaaaggtaataggcaagatgtctgccccctcctgcctcagcagctctctgacctcttcgttgtccgcaaaagcctggggctgctgagcaaggctgtggcgtacgacgcaaaatcctgccttggcaagggcgtcgagcacggctgacatcctcaggagctctgggtcgacactcggtccgcagatgccggtgggacagcacagggcagggtcgaaaacctcgatggtgtgcatggaaggcctcctcatatagatatacatcgaactattggacagtctagcaacatagataactgtcatatgaaaaggggagagcccgaggatgtttaaacgcatgctcttcgtgcagacggcaggaggaaccttatggagcgctccctcaacgaggctccattcagtaagaatgcggcttcccgaagggaagccgcgtcgtcgtctcttttttggttcggcggattagcattctgagtgcaacaggatggcccgccgaatgcaggctggcacatcccggaaggctacgatgttggttgtctaggtcaacgtcggaagctggaagatgtgccactacagtcatcttagcctcaggagagggactgcatagccacgctgcatgcagagggaaggtccatcggctacatcgcgggagagaccgggaggacagtcgaccatctgccgcgagctgaagaggaacgccggcacgggcgctatggggcatgcgccgcccagaggagggcggaggcgcgccacaggagatgcaggccgaagaggaggctctccgaccctgcgctcgcgcagaaggtgcgctcgctcatcatggacaggcactggtccccggacgagatagacggcaggctcaggctggagaacggcggaaggtgcgtcgtgagcctctcgacgatctaccgcgagtccatgcaggcacgctcgacctgccgggagccggcccaaggccaggtgcggcgccacctgcgcaggaagggaagaggatccgcaggaagaggcccgagacgaggggcaagatcaggatctcgcacaccgtggaggagaggccggcagaggccgatgcgaggtcgcgcctcggcgactgggaggacgacacggtagtcggtccggggtccgcatgcctgctcgtgctcgccgacagggcatcgaggctcctcctgcagggagatgccggcatgacagcgccagcgtctccagggccgaggtcgcgcttctggaggggcgcccgctcgagacggtgactccggacaggggcaaggagttcgcgggcatgcagatgtcacaaaggccctcggaggcgtgcagttctacttctgcgacccccaccatccctggcagaagccgacggtggagaacaccaacgggctcctgcgcgagttcttcccgaagggcaccgacttcagcaaggtgacggacgaggaggtgcagcatgcggtgggacctgaatcaacggcaggccgaggaaggtcctgaaatacaggacagccaacgaggtctacagggagatgttgcactcagcttgacaatctgccttctgaatcaggcgagctcttcgtcgaatgcccttgcgtactgcgtgaagaggcggtcgaagaagtaggtcagcgcgaaggttgcatagatgcggtgcattgcggaaccttcctcggcaccggtggccgatggtcagcacctcattgaaggcgctgtggagatcggggtcttccgaggcagtgatgatggccttgtcggcacggctctgcttgatgcgggcaatctggcgcttgcaaagcgttcgaggtcgtgaattgaatttcgaaaagcaatcctgttgcaccaagtcgtgcagcggccacagaagaaattgggggcaggacggattccgcatccatcctgcccccgcttcctctagccccttttgctgctgctggctcccgccgaagggagacacgatgagagacggcaagaggaagcacatggacaaggatagcagggtgatcatcgaggaaggcatacggagaggcgattccgcacggaagatagcccggaggagggtgagccccccaccgtgacgagggaggtgaaggcgaacaggaccctgaaggagaagaagagggcgccgggagcgaacctgtcggtgcgctgcgcgcgcaggaaagtgcccagggtgggcactgcatgcgcaggatgcagcaggccgggcagtgcgctgcagggactgcaggacgaggagctgcaaagatgcatgcccggacttcgagctgctgatgtgccccgtgacggagagatggccctacgtctgccccgaagggtgcaggaagcggcagacgtgcagctatccaaggagcaggtaccgcgcagaggaggcgcaggcggcgcacgatgccaggctcgcctcgagccgcgaggcatagacctcaccgccgacgagctcgagcggctgaatgcggtggtggcgcccctggtaggcagggatggagcttcgaggcgatctgcaccgagctcggggacgggctcggcgtctgcctgcgctcgctctacaactaccaggcggacgggatcctggacatatccagcgtcgagctgccgagaaggcgaggctcaggcccaggaagaggaagagggaccagggcaggccgcgcatcgacaggtccggcacgagtacccgactcctggcgctgcctccctggaggagagggccagggtcgtgcagggagactccgtctgcggcaggcagcagatgcccacgacatcctcacgctgcacatcgtggcgaggcacttccagctctatctcaggaagaggcatgcggacccttcgccaccgtcgcggcgctcgaccgcatcgagagggcgctggggtcgcgtgcggccttcgaggcggcgttcggcatcatgctccgacaggggcacggagttcgacgaccgggagggcatggagcgcagctgcctcgagcccggggagaggaatgccgcgtcttctggtgcgacccgcaggagtccaaccagaagtccgaggccgagcgcaaccacgagcacgtgaggcggatattcccgaaggggcatgtggacatggacgcgctcacggacgcaacgtggctccgcctgcagccatgtcaactcgtatcctccgcgtcgataggcggatgccccttcggcgagctggggtcgctcctgccggaaggggcgctcggaaggctcgggatcgtgcgcatccctgcggagcgcgtggtgctcaggcccgcgctcgtccgcatgcatatctaggtagcatagccgcatgcgctgcctgcggtgcgcagccggaggcagcggacgaaaggaatcgtcggccggagccggcagcagcgaatccgtccggccccctccgttgcatgaagtcgtgcaatcctggagagggggccgatattgccatggccggaatgcatgccatccggcgtcccggatgctccggaaggccgaattgcacgccttgccgcaacgcttccggcacattttgcaggacttgctgcaaccgttgcgcttcggattgcagtgttgcgcttacaaattcaatccaccagccgttcgaggtcgtgacgaccatcaggaggtccgtgggcatcatcgcggtcacgaagttgatttcaggggaggactcggagatgaggcgcacgaccctgccttctgcaagcatggcctgctggaactcgcgcagcgagagcatcgaggcgtccgtcgcgaagatgacagtgtgcttcgactcatggagggaggttacgaggcgcaggagcttgccttcctcagcaagcctgtctacctccgtatatatgcggtcaaggtcgcgatggaggtcgcgtccctcgtcgcgctctgcctttgcatagacaaggtaatggcggcgcagctctttggtctcttcctctgtcagagactgcggcagcatctggatcttgaatccgatctcgctcatgggaacctcccaggatatggcaggaacgaagcagccgccccgtgaggcggctgccattcagtctaatatgcgcctgctgtgaggatgctgctctttcggctgggcgtctaagccttcttctgagcggagggtgcatccacaagaagaaggacgcttgcgaagggcggcaggtctgcgcatatctttccggtctcaggatcgaaggcgacctttgccgtatcgtctggggtcgtgccgccgaagcgctcccagtcggagtcgaggatgaccgttgcggtcttggcatcaggcaggggcacgacatagtccttctgctcggcaccgctgaagttcatgagggcacaaatgcgctcgccttccttgctcctgcgctcgatggcatagcagaccctcgtcgtcgaggccacgtcgagccactggaagcctttctgctcgtagtctccctcccagaaggcagggtgctcgagatagaggtggttcaaggcagcgcagtagtggtagaacccgtcgtggatggggtaggagcgcaggaaccagtcctgctcgcgcttctcgtcccattcgcgcagctgggcaatctcggatcccatgaagttcagcttcttgccagggtggatcatcatgtagaggtagagcgagcgggcctgcgggaacttcttgtcgtagtcgccccacatcttctgggcaaccgtcgccttgccatggacattctcgtcgtgggagagcggcagcagatatctctcgttgtagtagtacatcatcgagaagctcagcttgtggtagttgccggcgcggaagtaggggtcggtctggaagaagctcagcgtgtcatgcatccagcccatgtcccacttgtagtcgaagtcgaggccgccctcggatgcgggctttgtcgtgccggcaaagttcgtcgagtcctcagccacaaggaagctgcccttgttgaggttcttgacgccggcattcatcttgcggacgaaggcgacagcgtcgttgttgacgcctcttgcctcgtctccctgccagtagatgatgcgggagatggcatccatgcgcaggccatcgaagtggtagcagccaagccagaagttcgcagaggactgcatgaagctcctcgactcgccgcgggaatacatgaagttgtgcgatccccactcggagacgccgaccgcatcattcggatactcgaagagcggcgtgccgtcgtagtcggctaggccatacgggtccgttgcgaagtgcacaggcacgatatcgaggatgcagccgatgcctgcctggtgcaggacatcgacgagctccatgagctgctgcggcgtgccgtaacgggaagtcgggctgaagaagccggtcggctggtaaccccaggagccgtcgaagggatactcgttcaggggcatgaactcgacgtagttgaagccggactccgtgaggtacttcacgaggggctctgcgatctcgtcgtagcggtaccagtccttcggatcgtctgtcggctcgtctcccgacttcttcctccaggagcccatgtgcatctcgtagatgttcatggggccgtcctcgcggtttgtgcgcttctgcatccagtcctggtcatgccaggtataggagaggtcccagacgatggagcggtgggcaggtctcagctccatctcgtagccatacgggtcggcatggttcacggtcctgccgccgtgcgtgattgcgtactcgtagggggtgcttgccttggcacctttcacgaagacctcccagaagttgccgtcctcgatcttgttcatcgggaaccgcttgccgtcgagcacgaggtctatcgactctgcggcaggcgcaaacgtgcggaacgtcacgcctcccaggacgagatgtgcacccagatattcatgtgcgaagtactcgttgcctacatagaagtcataggtcttcatctgccagctccttcgggcaccgcctatagggccgatacatctgtatcgggaaatgttctgtacaggtaaagaataggacatctgtcgggaaagcgcgaagcctcctcggcttccggtgtgcctatgccgcaggcggggcatggtaacggtcctgttgcggtgggtcttggaagccatgtttgtggaaaggacatctggccatatgggctacagttaggtgcatatgagaggcaggctcttgcctgcacgcagaaaggaaggtccatggagttcgattacaccacgctccccgagcgtgccggatatgatgcgatagcggtcgatgcgctcggcaagccgggagtaccgggcgctccgaaggagggcttcgatgctatcccgatgtgggtggcagacatgaatttccttgctcccccctgcatcaccgatgctatggctgagcgcctgaagcatccgaccttcggctacttcgagccgagggatgagtacttcgatgcaatcatccgctggcagaaggacagaaacggcgtccagggcctcacgaaggaggatatcggctacgagaacggcgtcctcggcggcgtggtctctgcgctcgaagccttcagctcgccaggcgatgccatcctcgtccacaacccgacctatatcggcttcacgggctcgatcgagcatgcaggcaggaggattgtccattctgcgcttaagcgcgacgctgacggcgtctggcgcatggatctcgaggacatggcacagaagatcgaggagaacaagatccacctcgtcgtcttctgcaacccgcataacccctgcggccgtgtctggacccgcgaggagctcgaggcggcaaatgcggtctatgcggcacatgactgcgttgtgatctcggatgagatctggagcgacctcatccttcccggacataagcacatcccgtaccagtccataaacgacgatgcaaagatgcgcacgatcgccttctatgcgccgagcaaaacgttcagcctcgctggccttgtgggctcctaccacatcgtctatagccgctatctcagggaccgtctcgttgccgcaagcacgcgcacacactacaacgcaatgaacgtgctctcgatgtatgccgctatcggcgccttctcgaaagaaggcgaggcctggctcgacgggctcctgccggtcctcgatacgaacgtcgatgtcgccgtgaagcatctctcggcccacaagggtgtggacttcttccgccccgagggcacctacatgctcttcctcgactgcgctggctggtgcaaggagcacaaggtctcgatcgacgagctccagcgtgccggctgggatgtgggtgtcgcctggcaggatgggcgtcccttccaggcaggagatacgatccgcatgaacctggcactgccgacggcacgtgtcgaggaagcgttctcacgcctcgaccgctacgtcttcacggactaggaaacacacgaaaggggaccttatggaaagcctcggcttcatcggcatgggcaacatggcacaggcgcttgcccagggcttcattgcatcgggtgcgctcaagggcgagcgggtctttgcctatgctcctcaccaggagaagctccgtgcgaatgcagagcgcatcggcttccaggcggttgcgtctctgaccgagcttgctgctgcagctgatacgctggtgatggcatgcaagccgtaccaaatcgagggtgtcgtggcagagctcggcgatgcgctttcgggtaaggccctggtctcgattgcggctggctgggacttcgcacgctacgagagcgtgcttccgcagagtacccgcttccagttcgtgatgcccaacacgcctgccatggtgagggaaggggtgctcctcttcgaggagaagacgagcttcgagaaggctgagcgccaagagctcatggacctcttctcgaccgtcggtgtcgtcgaggtagtgccaagcaggctcatgtcggcagcaggcacggtcacgggctgcggtcccgccttcgtcgacctcatgatcgaggcctatgccgatgcagccgtgaagtacggggtgccccgtgcacaggcctatgcgctcgtcgcgcagatggtgaagggttctgctgccctggccctcgagacgaatgagcagccgggggtcctgaaggatgccgtgtgctcgccaggtggcaccacgatacgtggcgtctgctcgctcgaagaggatggcttccgcgctgcctgtatccactcgatcgatgcaatcctcaagtagctggatccggaacatgcaggggatggcagaagcggcatggggatggctccctgtgccgcttgcctttgcatatgtctctgttagaccggcgaatccgcactccgagtgcaacagaatattacgaggcagccgcccaggcacgacctatgatgatgcttgcggagacatgcatcattggaggcaccatggacggctacagccatcttagcatcttacgcaccgcggaagatcactgttcacggcgagagcaatcaatgatccgctggaaaggggcatgaggggtcagccagatagcggggagctcggccgggacaagtcgacaatatgcccgcgagatcaggcgcaacggatgggcaggggccttcggacagcgctaccggcatcgaccgcacagaggcgcgcgacgcgaggaggctgcgctgcaggcgcccaggctcatggacgactctcatggagaggcgagacctggtcgtggagctaatgcgcgacgagcaactggtccccggaggaggatatcgggccgcaaatcgcgatggagcatccgagtatctccgccgtgagtgacggtacagaatctaccgtgccgtggaagtcgggtgtccatcgactgtgcgagattccgggatgaagaaggcatccaggatgctcagggcaccatggaaagcgcaggcagttgagagggcagccaggagcgcaggggggaagtccaggatcatcccatgacatatccgagcggccggaggaggcctcctccaggagccgcatcggagactgggagggcgataaccgtggcaggaagccagggagtggcgcatgcctcgcacccaggtcgacgcatgagcgggttcattgccggaggggaaggcagcagggaaggccgcatgcgagcgtcaacgacggacgacggagaaggcgcgtgccggccgggcgtgcatacggtcaagctcgaccaggggcaaggagttctccgatgcctaagggcgctgcagaggccgttggggctcccgtctacttctgccatccaaaccatccctgggagcgggggaccaacgagaacaccccaacggcctttcaggggctggttcccgaagggcatgagcctcgacgatgtcaccgacgacgaagtgcagagggtgtacgattcgccaaccggagaccgcgcaagcgtctgggggaagtgcccctgggagggtcgaccatcataagtcgttgcacttgctctgaggattcgccccagaatgacatggactgggcgtcaatactgtatgcctccccgcgtatgatgcagtcgcccagacagaacaccagcaggcggggaaacaggtgatcgacacaatgctcctgagatgtacaggagatcacgcttggcgacaagcgcaggctgatagaggcgaccaaggcggccgtggcgagggagcttggattcgtgcaggcgatgccccggcggcgtgcccaggtgagggtccgcgatttagtgcgcaagggaatggcagggatggctcgcaagaggtggctctgcaggggctgcggcaggacttctcaggaagacgatggggctccttgccctctccaaggctcctcggagacctgggggctgtacgtggagaggatgctgcaggcaggagggagacctcaggggcatgcgcggctgagcatgccatgtataccctcaagacatcctgcgttcatgaggtggatgcggatagcgaggtgatggagaagggcatgacagcccatgtcaggacgggccctccagatctggcaggtggacggcacctgcctcggacgaatcactctcaggaaacgggaagagggcccgcagtgaagatgccgagggcgccgcacaggcacggaggctccgtgcatgagcgcggcatctcgaaccagaaggtgctgcatcgtgtgcggcgcgaacagctcggcgactcctctgcagggcggtgggccgcggcaggccgacggacagggagctggaatcctcccatcacttcattcagacggctccccggtcgagacgatgccacaagggctatgccgcgtgcctgcctgggctcggcgaatcctcagtatcctccgaggcggcgcagggtcccatggcggccctcgggctcgtgaatgccctacaccagaggctaaagcgggttcaatcgccaagttcagcggcatatccaccaggcgcctcgtccacaccttgctggttcgaatggacggaagcaggcgcgcaagtcgggacgacctgcagtcggagatcctcccgggcaaggcggcgcagggcagatacgacaaacacccgcagagatgctcaccgacaaggagcagcccttatgggggctgggtggggcaggagagattgcatgtcaactgtgggctaacagagacttaaacagattgggacgtttcgaccgacgcatcgacttcaacacatgctcgacatgctgtatgcgagggtctttgccaaggtaactaccggcgcaatcttgaattcaagtcatcttcttagcgtgtgtcgaagtcaaccggcgtgtcgattgaatgtttgtgtgtaacttgccggtccgcgtgattggacggcatggccttgctccattcatggatgccttcagcggttcggccgaagcaaggcatcctgatgaggtgcagatggccattctggcatcgtcgtccatgcgatgcccctgcctgagtgatcgagaagcactatggataggatggaatccttctgcaaagatgcggctggctgagagccttgacttgctgcagctctgtaccgtttgccgaaaatgaatgacgctagtcgtttcggaacccggtccggacaggtcgtacaaaatgctcaaacatcgccggtgtgggcttttcgatgcatacgaagaataaaccttgttatcgcccgggccgggcaaatggtagcagtagttgggagctaggggttctatggttccagcggcgatgctggatttcagaacagggagaggaaggtcagttatgaaacaacaaggcaatgtctgcaatgcagaaattctcgaaagcatgttcatttcccgtgctcaattctgcctattgacaggccatcatgatgcagtcaggcaatgtttttcaccaatgcgacgctcatcagatggttaagcctttcgacaatcccagaacggaagggattcggaacgattcttctggatccttgagtggcgcatcgaaccaattggcgttaatttctgtgtcggcctcgcaacaggccatggcgagcaagaagaaggagaggcgggcttcacggcgcttttgcatcctggtcgtcatcaaatgccactgaaacaagttcatgggcctgaaacgatatgctcgtcgcatccgatgccttcgcggaagggccagctctggtcctgggcgttccaggtgtctggatatgggcgtgtttctgggaatcatgcttgggactgtcaccgatgctggccataaacccgcttcatcgtaccgaatcgacaatgcctccagatctatggtgcaagagattcgtattcattgtcctggagtcctgtgcgatcctcaggcaatcgtgctcacgtatgttgggccaatcatccagcttggcatcgacaacaatgaggttattatccatgcataaggccaaccttcggcatttctgtatggcatgccttcgaaagcgtctcctgattcgacgggcctgcatcacctggtctatacgccgttcttgtatacccaagctcggtggcgtggccgagtagaggccagatctatgaggcgcaagaaaaacatctactatgcggacatcccgatctcgaaacgtgacgctcctttccccaatctgttgtatcggattgcagcggcctttcgagagatgtttggcctcatcgggcgcctgcctgccatgtacaagaccgcaagcctgagaaaccgtgcgaggtcaatggcatcatcattcctgcggcggtcacctcgttcatcgcagcgtcacaggagccgatcgcgttctccttcctgttcgtgcgccgatccgtcgtggtccacgcgtcctcagcggattgggaatggtcgagcattcagttgtgttcaaatgccgcgcatatcggacctaatggcttcctggatttcattctgtcacaaccttccgtcggccactcggcaaacaagacgcattggccgacatatatcctgattggcctttgcccgaatttgcggtctactacgtctcttctatctgctcattcaccaactcaacgaagacgcttggccgtgggacgacgaggagcggagatgaagctccactccaaggcagagtatctggagaaggcctgcacaagaattgacgagggttccaagaagaggatggagcatcgtcgaggtgatgaggccctcattgtcgaaggccctggtgcaaagacaacagtcagaaggtggacagctgcttcacaaggctgaggctcgtcgtgaaggattcgtagcttgtcgatgaagcgacattgaagaatgacaccggtgccctggggatcttcaaggacggcgagaccgtccaggtcgtctatgctgggaatcaaacaagggccgacggcgcaagtcgaggcatacctcggaaacgaatgtgattgaactgctccctgaagccgaaaggatgggagaaggcaatggatggaaagaagttgcaatatcgttatttgcaggagcggacccgcacctatacacccgggcatcgtgaagagatgctcacggcaccgcgatgatttccccgctggcagcgatctaccatctccgaaaacgatcctgagaggcagagaaagatcggccgtgcgctcgatatcgttatccgtgaggaggcccctgaggtggatttcagctacacagacgatcccgcagaggcattcaagtggcaaggacttctgcatggcacacatccgcgtcggcgggctgccatgcgccggggacgagacgatcccctctcaagtacggaggcgtcggccaggcgacgtgcgggctggcggcattgcctacggcatgcgcctccatcacaggggatgctccgagatcattgattatatggaggagattcacatgactgctggatctgaactactccaatccagcatcaatcgtcgatgaagcatgcgagtgctcggcaaaggcaaaggtcatcaacatctgcggacatgccagtcgcgcacgagaggcggtgggctttcatcgcggggcctgccagctacgaggatctcgacggccgcttatttgggcataaacacttcggatgtggacttcggtgcatgatgtccatacggagggactgttgcccagctgacgattatgtctcccagaatggctatatgacgcagaaggcgatagagacgcagcaatggatgcaagcctggaaggcaacgacatagaggcaaagggcccttctggcgctcgatccggcattccttccaatacctatctcaagtctatctttatccaggactctgtgtgagcatacggacccggaatcatgtgcggaccgtgaggtggtggaaggacgcgagaagcaggtattcaggtgcggcgaagcagattgtagagaaggaaatgccactggcggcgagtttcacggtggcaacccacgctgagttcatccgtccccttgccgcgccattgcatacaaacacccatgagatcatggatctgcaatcgtggaagaacaagggccgccatcgagaactcgattcggatgctatggtgaagtgccctgagtggtcggcagtaatgggcctgaagcccctctgccaggtgaagatccccctgctttgagcggggtctgatgtcggaagcagcttgcggtcgcagaatagctggtcgtagaagcgtattgccggggcaacagctatctcaagatgtggcaagcgcggacgctctacaagacagtaccgaggcgcctccattgcgaagaagatcctggatgacctgattgtcgccaatgacggctggtggcccgagctccattagcactgcaatcaggggccaatcttagtaccattggagcattggatcatcgtgatatcaagaaggcgctcaaggaggggctgcggtttgggggtatgagatgatggatgggcatattgacctttcaagctggtacagaaattcggcacaatcggtctgagacggaagcggcagttctctgccctcatagttgaaacaccgggattctgccaggaagtgggagtacgtggcatgcgcgggaagctatacctcgccttccaccggaatgcgggtgcaaagaagctcggttatcgcggctatgtcgaatgtgctacgggctccaagaccttcggtgaaggcagggagcaagcggatgagatcatacgaggacggcggagctctggggcattgcgaaggcttgatgcttctaccgtcctcccacgagcgggcatcgagttgctgaaggagtgagcttcgagtgtctcggttgagggatattcttcgctgctcgcaagatacttcacgagaagctgctgggcatgggaagaaagtgctcttcactcagctgttgatgcggttgccatctgcgagaggctttgcccacaatcgctgcgatcgtgctctgttccgtttggcaggacacagcacgtcctcgaccgtctcgacaaggcctcatcggaagcgtaccctccatcgccatcacgggcgtaacaccagcccgattgcagagaaagcaacctgccacgatctggatgaggggggggggaaacgaccagcctatttgatgcagaaatacaaagcctactgctgttccgcgaagggcccttctggcgagtagagcaatgcagcattgagccagatgggatgttgaggcgctccacgataggcatttgcttgccaagccgatggacctgattctgctggcagcgatactggagactatcgggaaaccaaagaggagaacatgcttgaagagccaagaagtgaaaagatagctccggaattgagcccctgcgcaaggtgcgggtggagcaatagacgatctctcgaagccccagagtctgatgaaagacgttcggagattcccacccaggaagttctggccggaatgcgcttgtggaccgggtgcgtgcaggatagcatagagaaggagggtttgagccagtatttctgccaccgatatgtgcgatggagaatcgaagggggacgccaggcggagacgattccttccttccacgggaattcatcttgcgacatgatccgagatccagcacaggcaagccatttgatggaggggtcttcatcggcaagctggacaaggggctccctgccaaatctaatgggcaataggcagggtcaaaattccttcgattgtcgtgaagggcggcgtgatggatgcggacccgactggcggaatggagcagtaggcaagtacagcgctcaatgccggcgaggagaagattgctccggggcagatgagaataatacaagcatccccctcccccccccccccccccccccccacatgcatgccgtcatgtggagcctgactcgttcatgggacaaactgcctgaccatttgaggtaacgcagaggcattgggcctcctgctccctggaacgctcttcttccggcacgggtcgaaatactcgaaggtgcatatcaatcagggcggcaggcagtcagggttgtcaagagcgggcattgagcccgtgatatcgtgcccggattctttcgagaatgcgatcctggttcagccggacagtatctggtatagacaaatgcactgctggccatatccagcgatagcccccccccaggaattggccttgaggtcagggcagacagtttgatgccctgcacaggaaagcgcgctatctgggcgaaattaggccggcaggtgagtggcccgccacagtttcctgcatgatgcaggaggcgttcctgcgatcatggaagatgattgccgaccagctccattcttgatgcgatgacaggacgggaaagaaacagtcggagagaatatcgaagatctccgtggcggggggctattcgagaaatgcgaatcgagctcaagaaatggaaccgttccgaacacggtgtgataagccgcatgaccatcccaagatggacaacggcagcatagcggatactccaaaggcaacctgcaccgacggagcggttgtgaaagcataatgttgtctccacaaacgcatgtgcatgctgttctgcaggcacgtccttcggaatgtgaaccgatgcgatcggatgcggttctcaagcatcaggtccatcctggcgatgcgcatagtcagttatgcggacgaagggcctgggaatgcccgagatgttctatagacggaaagcgatcgcatcagatgagagattggggattacgatgcactgatcactgacgggcggttcttccggtgctccaagggtcattccagggccatgtctcgcagcgagcggctgagggcgggtccgatagctcttggtcgaagaaggcgatctgatgaaatcgatctcgcagaacaggcggcttgcaatcgtaggcatcaagggcgagcggaaaggcaacggaagagattgaatcggttaggaagcagaaagaaggctggagcgcggccgaacagattctcgcagggtgatgaagctgtactgcgcgtatgcaaatcagccatcgatggaggctacatggcgtagaccttgggcttctggcatctgtggggtgctgagccgcggggctggcaaggccttgcgaaatgtcaccaccggtgaagaagagagggagcatcctattttgcggtgcatcccttcatgattaagacgatcgatggccaaatcaatccatcagggctggtatagccttctgctttggcaatccggtaagagccatgataggaccccagttgagattgttagcgccgggcgactttagggtcttgcattttcctgtgtgcggacccatctcagtacctgtcctccggtatgaggcatcgactatgcttgaggaagaaatagtcgtcgtccggatagccgtatcccttgcgcccaatgtcttgatgaggttgctggtgccttccaccatgccatgtcgagagagggcctcgtatgggcgacgtatcccgccgaagtggattcgagagcttgcgaaacaatgcgaagtggctgtcacacggtctaacggcacatgcgtatcgtgtcccggatgcgcatgccattactccgtgatgggtagagcgtgtggcatctctcagcttctccttcacgagggcgacacgcaaggcaggagactagttgccttccagggccgtcgtagcggctctgtgctcaggccttccggaagccgcccggctttgccgaacagctcgcccgagttcgcgcagggcggccatcattcggactcgcgctcaccatctcgcgctgggccgggcagaggacatcagaaggtacttggtgtgctcagcttccgggcgcggcctcctggtcggcccttccggacaagctcgtgcgaggtccttctgaattccgatatcaccttctcgatgaagttcttcacgatgcggaaggggtcatatacatatccagatgagggcagagctcaggaaacgcctcctggtagtcggagttaatgtcgctcgcacctccggccccaccccgccatcattctcatgccgtgcgcagtacacgaagccgtacatgacctgcttccttccgtgggcaacccagaggacatgccccgtcacaggtcgcgaatggtcgcatagcggtggccatcacttgcagcttggaactcgtgttccccatgcgttcggcggcctgtccggaaagctcaggctcctctgcccgtccttggggccatcctcgagccacagccgctccgccgccttccggtcgatgtccttcacggaattgcggacagccccgtgacatgcgccgtctccttcagccgtgaagccgaagcgcgtacgcagagccccctccgcgtagcgcgcgaggcctcggtgccacatgtggcctcagccctgaagggatggatacgccaggcacaacccgcattacgggcaagcgaatactctgtcgctctaggcaagcttgacagggtgctccgattggggatgtgcaggagcaggcatgggggccgtgccgttcctgtggagcgcccctccgcatttccggagcatggggtgtccggcgcggatcgttccccctgaatgctcagatgctcacgtccggtaactcggctcggacttcgtccgggccctgtcaatataatggacagtgggatttccagatttaatgctgagactccggcataacccaggaactctggcgccgactcgcgggcatcatatggatgaaggctgatgcatccgaagagcggaggggcgctccacaggaacggcacggacccatggccatgctcctgcacatcccccatcgggaggcaccctgtcaaggatgtgatagagcgaagcggatgcgctgaccggaagggggtggtgccgggcggatccatccccttcaggggggaggagggccacatggcaccgaggcgctcgcgcgctaccgcggaggcctgctcgctacggcttcacgctgaaggatgaaggagacggcgcatgtcacggggcctgtatgctgcgcatgccgtgaagacatcgaccggaaagcggctggagcggctgtggctcggaagggtgggccaaggacgggcagaggcagcctaggattccggaaaggccgccgaagcacgcatagggatacacgagttcaagctgatgctggtcaccgctatgcgaccattcatcgccgactggaggacggggcatgtcctcgggtggcccaacggaaggaagaagcaggtaatgtacggcttcgtggagcgcgcaggccatggaaatggatggcgggggtggagggcgccgtggcgagcgacatgaactccgactaccaggaggcgtgtcatggagctattttttgtggggggcccggcatctggataatgtaatttgaaccacgttccgcatcgtgttgaagaacttcagcgagaaggtgatatcgggaagtcaggaaggggacatccagcaacgagcttgtccggaagggagacaaggatggccgacgcggaagcctggcaagctgaagcacaccaaagagtacctgcttgattcctctgccggccaaaccgcgcgagattttgggagcgcgaggccgaggaggggcccccgcccgcgaacgcggggcggaggatgttcgccagcggagcggctccggaagcgggagcacagagcgtacgaagagctctatggaaggaaacgagcgcctgctggatgtgcgacctcgtgaaggagaagctgaagatgccctaccacgctctccagcacggaggagatggaatgcgccatccgggacacgatacgcatcatgcgggagacaggggacagccacttcgcatggttcggcgacgggctgctcgatcccacttcggcgggatagtttttcgcccatacgaggcaaagctctcgaacaggcagggtggaatgggaactggcaccaacaacctcctcaagacattgaggcgaaaggatacggctatccggggacgacgctatttcttcctcaatagtcgatgccctcataaaaaaggggggtaaggacaggggtacgatgggggcctgcaccaccaggaaataatgcaatgaccccctacaattcgcccgccgcaacaatctcaaactgggccattcatgcatctttatccggattgccaaagcagggaaggctatagacagccactgagtggatggatttggctacggatcgcttatcaatgaaggggattgcaccgcaaaatattgatgcatccctctctttattcaccgttggtgacatttcgcaagatggacagccccgcggctagcatccacacaaggatgcaaagccagaggctacgccatgtagcctacatcgaggctgatgttgaatatcgcaggacagttcatcacccatgacgagaattgttcggccgcggcttccaagccttctttctggcttcataaccgattcaatctcttacggtgcctttcgctcgaccttgatgactacgattgccaagccgcatgttctcgatatcgagtgttcaatcagatcgctcttcgaccagagctatcggaccgcactcagggccgcctccggcgagaacatggccaatggaaggacccttggaggccacgggagaaacgccacgtcagttgatcagtgcaatcctatccccaagctcctcatcggatgcgatcgcttccgtgtatagaacatctcgggcattccaggcccttcggtcccgcatcacggacgatgacggcatcgccaggatggactgatgcttgagaaaccgccacgatcgccattcgttgtcacagtcgagaaggacgtgcatgcagaaagcatgccacatgcgttggggacaacagtacgcattcacaaccgtccgtcgggttttgcaaggttgccttcgagtatcgcgaatgctgcgttggccatcatgggatggtcatgcggcttgatcacaccgttgcgggaaacgtgcatttttgagctggcgcatcgccatttctcgaaaaaatagcccccgcacggagatcttcgagattcttcgactgtcttccgtcactgtcatcgcatcaagatggagctggtcggcaatctcttactgatcgcaggaacgcctcctgcataatgcaggaaactgtggggccactcacactgccggcctaatattcgcagatagcgcgctttcctgcagggcatcaaactggtctgccgtgacctcaaggccaattccgggctatcgctggataagcagcagtgcattgtcgatccagatagctgccgcaatgaaccaggatcgcattctcgaaagaatcagcggtcacgatatcacgggcgcaggatgccgtcttgacaagctgactgcctgcgccctcctgattgatgtcagcctcgagtatttcggacccgtgccggaagaagagcggttccagggagcatgaggccaaatgcctctgcagtgacctgcatggtgggcatttcccatgaacgaagcgctccacatgacgggcaggcatatgctgtagtattccagctgcccggagcaatctcctcgccggcattgagcgctgttacttgcctatcgtccaaagctcagcaggggggtcccgcatccatcacgcgcctcacgacaatcgaaggaatgtgaccctgactattgcatgagagtgcagggagccccttgtcgcagctgcgatgaagacccctccatcaaatggcgttgcctgtgcatggatctcgatcatgtcgcagatgaattccgtgaaggaagggaatagtctccgcctggcgtccctgcgattctccatcgcacatatcggtgcaaatactggctgctccaaaccctccttcatctgctatgcctgcacgcacccggtccacagcgcattccaggccagacttcctgggtgggaatctccgaacgtgctttcaatcagaatctggggcttcgagagatcgtcgtgctccaccggccacctaggcgcaggggatccatttccggagagatctttctcacttcttggctcttcagcatgtttgctcctctttggttcccgataggtctccagtatcgctgcacacagcagaatcaggtcatcggctggcaagcaaatgctaatcgtgagcggcctcaaatccatctggctcaatgcggccattgcctctatcgccagaagggcccttcgagaaccatgcagtaggtttgtatttctgtcatcaaatagctggtcgtctcaatccagatcgtgcaggtggctttctctgagcgggctgggttgacgcccgtgattgcgatggaggggacgccttccgatgaggccttgtcgagacggtcgaggacgtgctgtgtcctgcccgaacgggaaaagagcacgagcgcatcgattgtgggcagaaggctctcgaagatggcaaccgaatcaacagctgaagtgaagagcacttttcttccatgcccagcagcttcttcgtgaagtactctggagcgcgaagaatatccctcaccgtagacaagcgaaagctcacttcctgccacaactcggatgcccgctcgatggaggacggtatgacaatcaaggccttcgacaatgccccagagctccgccgtctcgtatgatctcagtccgcttgcctccctgccttccacagaaaggtcttggagccgtagcacaatatcgacatagccgcgataaccgagcttctttgcaagccgcatgacgggggaaggcgaggttatagcattcccgcgcgatgcccccgtactcccagcttcctggcagaatcccggtgttcaactatgaggcaagaactgcgcttccgtctcagacagattgccattctgtaccagcttggaaaggtcaaatgcccatccatctcctaccccaaacagcaggcccctccttggaagagcctgctgatatcacgatgcatccaatgctcatggtacgaagattggcctgatttcaggtggtaatggagctcgggccaccagaccttcattgcgacaatcggtcatccaggatcttcttcgcaatgagggcgctcggtactgtcttggagagcgtcagcgcttgccacatcttgagaagctgtgcccgcaatacgcttctacgaccagcttctcgaccgcaagctgctccgacatcagaccccgctcaaacggggatcttcccctggcagagggcttcaggcccattactgccgaccacgcagggcacttccaccatagcatccgaatcgaagttctcgatggcgcccttgttctccacgatgcagatcatgattcatgggtgttgtatgcaatggcgcgggcaagggagaacgatgaactcagcgtggttgtccaccgggaactcgccgccagtggcagttccctcttccgacaatctgcttcgcgcgcaccgcaagaactgcttctcgcgtccttccaccacctcatcagtccgcacatgattcgggtccgtatgctccacacatagtctggatagagatgtactttgagataggtattgggaaggaatgccggatcgagcgccagaaggtcctttgccttgcgatgcgttgctgccagcttgcaccatatgctgcgtctctatcgccttctgcgtcagaagccattctgggagacataatcgatcagctggggcatcagtcctctccggtatggacatcatgcaccgaagtccaccagccgaagtggttgaggcgcgaaatagcggacgtcgagatcctcgtatctgcggccgcgatgatgaagccatccgccttctcgtgccgactggcatgtcgcagatgttgatgactttgcctttggccggagcactcggcattgcttcagcgacgattgatgcggattggagtagttagcatccagcagtcaggtgaatactcctccatataatcaatgatcgagcacctgtgatgggcgcatgccgtaggcaatgccgccaggcccgcacagtctcctggccgacgactccgtacttgagagggatcgtctcgtccttccggcgcagggcagcccgccgacgcggatgatgtgctgcatgcagaagtccttgccagtgaatgcctctgcgggatgtctgtgtagctgaatgccacctcaggggcttcctccacggtaacgatatcgaggcacggccgagcttgctctgcctctcaggatcgttgtcgtagagggtgatcagccagcgggaaatcatcgaggtgcgtgagcatcatcttcacgatgcccggtgtataggtgctgccgcctcctgaataaacgatattgaacttctttccatccattgcttatcccatcctttggcttcagggagcatttcaatcattcgtttcgaggtatgcatcgactgcgccgcggaccttgttgattcccaggccatagacgacctggacggtctcgccgtccttgagatccccatggcaccggtgtcattcttcaatgtcgcttcatcgacaagcgacgaatcttccgacgagcctcagccttgttgaagcagctgtccaccttgaagtgttgtcttgccaccagggcttcgaaatgagggctgcatcgacatccgatgcgccatcctgcttcttggaaactcgtcattcttgtgcgaggccttctccagatactctgccttggagtggagcttcatctcgctctcgtcgtcctcacggccaagcgtcttcaggttgagtttggtgatgagcagatagaagacggacgtagtagaccgcaaattcgcacaggccaatcaggatatatgtcggccaatgcgtctgccgatgccgagcggaaggttgtacagaagaaatccaggaagccattaggtccgatagcgcggcagttgaacacactgaatgcgaccattcccaaccgctgaggacggcgtggaccccgaaacaggatcggcgcaacatgcaacgaacagaggagaactcgatcggctccgtgacgcctgcgatgaacgaggtgaccgccgcaggaatgaggattgccttgaccttcgcacggttctcaggctttgtgtcttgtacatggcaggcaggggccgatgaggccaaacatcttcgagaaggccgcgtgcatcccatacaacagattgggaaagggcgtcacgttcggatcggcgatttcgcatagtagatgtttcttgcgccctcatagatctggccgcctacttcggccacgccaccgagcttggtatacaagaacgggtatagaccaggtgatgcaggcccgtcggaatcaggagacgctcgagcatgccatacaggaagatgccgagttgcctgatgcctggtgaagtaacccaggtgtcgatgccaagctggatgattggccagacatacgtgagcacgattgccggagatgtgtcacaggaatcaggacaatgaatacgaatctctggccaccatagatctggaaggcattgtcgaattcggtacgatgaagcggttatggacagcagcgtgacaagtccaagcatgattcccagaaacacgcccatatcccgcacctggacgcccaggaccagagcctggccacttccgcgaaggcatcggatgcgacgagcatatcgttcaggcccatgaaatgttcatggcattgatgaagaccaggaatgcaagaagcgccgtgaagccagcctctgccttcttcttgctcgccatgactgtgcgaggccgacacagaagatgacgcccaagattgttcaggatcgccaccaagagatccagagagatcgttccgaatcccttcgtatgggattgtcgaagagcggaaccatcttgatgagcgtcgcattggtgaaaacattgcctacggcaatcaggatgccggcaataggcagaatgagcacggaatgaacatggctttcgagaatgtctgcattgcagacattgccttgtgtttcatgaatgacctccctcccgttgcaaatcccagcaatgcgctggaaccatagaaccctagatcaacaaatactggcaccatttgcccggcccggcgataacaaggttattcttcgtacatcgacaaagcacaccggcgatgttgagctttgtacgacctgtccggaacgggttctcgaaacgactagcgggcattcattttcggcaaacggtcaagagctgacaggtccaaggcgcagcagccatctttgcagaagagtccatcctatccatagtgcttctgatccctcaggcaggggcatcgcagggcgacgatgccagaatggccatcatgcaatcatcaggatgcttgcttcggcagaacagctggaaggcatccatgaatgagatggagccaatgccaagcgtccaatcacgcggaccggcagttaccagcacaatacattcaatcgacacccggttgacttcgacagcacgcgaagaagatgacttgaattcaagattggcgcccgtagtccttgcaaagaccatcgcatacagcatgtcgagcaatgtgttgtcgatgcttcggtcgagaacgtccaatcttgttgtaagtctgttagaccacagttgacatgcagctctctgctccaccagccccagagggctgctccttgtcggtgagcatcctgcgggtgttgtcgtatctgccctgcgcgccgggccgggaggatctccgactgcagggcgtccgaattgcgcgtgctccgtccattcgaaccaggcaaggtagtggacgagggcctggtggatatgccgctgaacggcgggagaaccgcttgagcctctggtggagggcattcacgagccgaggcgccatgggaccctgcgcccgcctcggaggatacggaggatggccgagcccaggcagcacgcgggcatagcccttgtggccatcggtctcgaacggggagccgtcgaatgaagggagggaggattccagctcctgtcgtcgcgcctggggcccagcgccctgaaaggagtcgcgaggcgtgttcgcgccgacaccgatgcacaccttctgttcgagatgccgcgctcatgcacggagcctccgtgcctgtgcggcgccctcggcatcttcacggcggccctcttcggtttcctgagagggattcgtcgaggccgtgccgccacctgccaggatatggaggggcccgtctgaagggctgcaggccctctctcctcacctcgcatatccgcatcctcatgaaccaggatgtttgagggagacatggcaggcagccgcgcatgccctgaggctccctcctgcctgcagcatcccttccacgtacagccccaggtctccggagggagcttggagagggcaaggagccccatcgtcttcctggagaaggtctgccgcagcccctgcagagccacctctgcgagccatccctgccatgcccttgcgcacgaaatcggcggacccgcacctcgggcacgccgcggggcatcgcctgcaccgaatccaagctcctcgccacggccgccttggtcgcctctatcagcctgcgttgtcgccaagcgtgagctcctgcatctcatggagcatggtgtcgatcatcctgttcccgcgtgctggtgttctgtctggcgactgcatcatacgcggggagcaggacagtattgacgccatgtcatgtcattctggggtcctcagagcaagtgcaaagactgatgatggtagacctcccaggggcacttccacccagacgcttgcgcggtctccggttgagcgaatcgtacaccctctgccctcgtcgtcggtgacatcgtcgaggctcagcccttcgggaaccagcccctgagaaggccgttggtgttctcgttggtcccccgctcccagggatggtgtggatggagaagtagacgggagccccaagcgcctcctgcagccccttggcatcggagaaatcttgcccctgtcgaggtgaccgtatgcacggccccgcggaagcgccttctccgtcgcctcgttgactcggcatgcgccttcctggctgccttcccgccggcaaggaacccgctcatgcggtcgaatgggtgacgaggcaggcgcctcctggcttcctgccacggtatcgccctcccgactccgatgcggctcctggaggaggcctcctccggccgctcggagatgtcatgggtgatcgggaattcccctgcgctcctggctgcccttcacgtgctgcgctttccatggtgcctgagcagcctggatgccttcctgcatcccggaagctcgcagtcgagggaccccgactccacggcacggtagatgctgtcgtcactcaggcgaggctcggatgctcatcgcgatgcggcccgatatctcctccggggaccagtgctcgtgcgatgagctccacgaccagggcgcgcctctccggatcgtccatgagcctggggcgcctgcagcgcagctcctcgcgtccgcgcgcctctctggcggtcgatgacggtagcgctgtccggaaggccctgccatccgttggcctgatctgcgggatatggtcgacttgtccctgccgagctccctcgctatctggctgaccctcatggcccttccagcggatcatgatgtcctcgcgctccgcgatgctaaatggctgtagccgtccatggtgcctaatgatgcatgtctccgcaagcatcatcataggtcgtgcctgggcggctgcctcgtaatattctgttgcactcggagtgcggattcgccggtctaacagagacatagcaaaggcaagcggcacagggagccatcccatgccgcttctgccatcccctgcatgttccggatccagctacttgaggattgcatcgatcgagtggatacaggcagcgcggaagccatcctcttcgagcgagcagacgccacgtatcgtggtgccacctggcgagcacacggcatccttcaggacccccggctgctattcgtctcgagggccggcagcagaacccttcaccattgcgcgacgagcgcataggcctgtgcacggggaccccgtacttcacggctgcatcggcataggcctcgatcatgaggtcgacgaaggcggaccgcagcccgtgaccgtgcctgctgcgacatgagcctgcttggcactacctcgacgacacgacggtcgagaagaggtccatgagctcttggcgctcagccttctcgaagctcgtctttcctcgaagaggagcaccccttccctcaccatggaggcgtgttgggcatcacgaactggaagggtaactctgcggaagacgctctcgtagcgtgcgaagtccagccagcgcaatcgagaccagggcttaccgaaagcgcatgccgagctctgccacgacaccctcgtttggtacggcttgcatgccatcaccagcgtatcagctgcagcagcaagctcggtcagagacgcaaccgcccggaagccgatgcgctctgcatgcacggagctttcctggtgaggagcataggcaaagaccgcctcgcccttgagcgcacccgatgcaatgaagccctgggcaagcgcctgtgccagttgcccatgccgatgaagccgaggctttccataaggtccccttgtgtgtttcctagtccgtgaagacgtagggtcgaggcgtgagaacgcttcctcgaaacgtgcgcgggcagtgccaggttcatgcggatcgtatctcctgcctggaagggacgcccatcctgccaggcgacacaccacatcccagccggcacgctggagtcgtcgatcgagatgtgtgccttgcaccagccagcgcagtcgaggaagagcatgtaggtgccctcggggcggaagaagtccacacccttgtgggccgagagatgcttcacggcgacatcgacgttcgatcgaggaccggcaggagcccgtcgagccaggcctcgccttctttcgagaaggcgccgatagcggcatacatcgagagcacgttcattgcgttgtagtgtgtgcgcgtgcttgcggcaacgagacggtccctgagatagcggctatagacgatgtggtaggagcccacaaggccagcgaggctgaacgttttgctcggcgcatagaggcgatcgtgcgcatctttgcatcgtgtttatggactggtacgggatttgcttatgtccgggaaggatgaggtcgctccagatctcatccgagatcacaacgcagtcatgtgccgcatagaccgcatttgccgctcgagctcctcgcgggtccagacaaggccgcaggggttatggggttgcagaagacgacgaggtggatcttgttctcctcgatcttctggccatgtcctcgagatccacgcgccagacgccgtcagcgtcgcgcttagcggcaaatggcaatcctcctgctgcatgctcgatcgagcccgtgaagccgatataggtcgggttgtggacgaggatggcatcgcctggcgagctgaaggcttcgagcgcaagagacacgccgccgaggacgccgttctcgtagccgatatcctccttcgtgaggccctggacgcgtttctgtccttcgcagcggatgattgcatcgaagtactcatccctcggctcgaagagtgaccgaaggtcggatgcttcaggcgctcagccatagcatcggtgatgcaggggggagcaaggaaattcagtctgccacccacatcgggatagatcgaagcccctcttcggcgtgcccggttactcccggcttgccgagcgcatcgaccgcatcgcatcaatccggcacgctcggggagcgtggtgtaatcgaacccatggacctcctttctgcgtgcaggcagagcctgcctctcatatgcacctaactagctatagccatatggccagatgtcctttccacaaacatggcttccaagacccaccgcaacaggaacgttaccatgccccgcctgcggcataggcacaccggaagccgagggggcttcgcgctttcccgacagatgtcctatctttacctgtacagaacatcccgatacagagtgtatcggccctataggcggtgcccgaaggagctggcagatgaagacctatgaattctatgtaggcaacgagtacttcgcacatgaatatctgggtgcacatctgtcctgggaggcgtgacgttccgcagttgcgcctgccgcagagtcgatagaactcgtgccgacggcaagcggttcccgatgaacaagatcgaggacggcaacttctgggaggtcttcgtgaaaggtgccaaggcaagcacccctacgagtacgcaatcacgcacggcggcaggaccgtgaaacatgccgacccgtatggctacgagatggagtgagactgcccacgtccatcgtctgggacctctcctatacctggctgaccaggactggatgccgaagcgcacaaacgcgaggacggcatgaacatctacgagatgcacatgggctcctggagaagaagtcgggagacgagccgacagacgatccgaaggactggtacgctacgacgagatcgcagagcctcgtgaagtacctcacggagtccggcttcaactacgtcgagtcatgccctgaacgagtatcttcgacggctcctggggttaccagccgacggcttttcagcccgacttccgttacggcacgcgcagcagctcatggagctcgtcgagtcctgcaccaggcagatcggtctgcatcctcgatatcgtgctgtgcacttcgcaacggacccgtatggcctagccgactacgacggcacgccgctttcgagtatccgaatgatgcggtcggcgtctccgagtggggatcgcacaacttcatgtattcccgcggcgagtcgaggagcttcatgcagcctctgcgaactctggcttggctgctaccacttcgatggcctgcgcatggatgcatctccgcgcatcatctactggagggagacgaggcaagaggcgtcaacaacgacgctgtcgccttcgtccgcaagatgaatgccggcgtcaagaacctcaacaagggcagttccttgtggctgaggactcgacgcgactttgccggcacgacaaagcccgcacgagggcggcctcgactcgactacaagtgggacatggggctggatgcatgacacgctgagtcccagaccgacccctacttccgcgccggcaactaccacaagctgagcttctcgtgatgtactactacaacgagagatatctgctgccgctctcccacgacgagaatgtccatgcaaggcgacggttgcccagaagatgtggggcgactacgacaagagttcccgcaggcccgctcgtcgctctacctctacagatgatccaccctggcaagaagctgaacttcatgggatccgagatgcccagctgcggaatgggacgagaagcgcggcaggactggtttcctgccgcctctaccccatccacgacggtgctaccactactgcgctgttgaaccacctcttattcccccagtactttttgtcctaccctgctgtgtccgggaggttttttccccctttttttttttttttgagttgtactacgagcagaaaggtattccaatgcgttctggacataccgacttccccccccctttttcttttcggttgaccaccgtacagaatggggaccctatccccccccgccctttttttccattctctatgccctttcattcgagcgcagttttcttccttggagcaaggaaggcgagcgcatttgtgctcatggaacttcagcggtgacgagcagctcagagaagcagagaagagaattccggaggagagaacggacctaggtcggcccctctctcttccctttcctctcctttggccttctctctgcctgatgcccaaaaagaccggcaacgtctttcaatcctccgactccgagcctgggagcgctcggaggcaacgaacacacatacacacgaccccagaagcatacggcaaaaggtccggcgttttccttcttctttttttcgccctcgatctgagccgagaaaaacggaaaaaggaaagatagcgcagacctgcgcacccccctcgcaagcgtttccttctttgtggatgcaccctccgtcaggaagaattagaagagaaagaagcttcttatagacgccagccgtaaaaagagcagcaacaaaagagcagcatcatacagggcaggcgcccgactaccaaaaatatatttcagaataaggccgatatttgagacatttccataattaggccgcgcataatattagaaacgcatattagactgacatggcagccgcactaagggaggcatgcttcttataatgaaatatactgggaacggtggaacaagtctcccatccatgaagagagatcggggatcctggggggattcaagataaagcatgcattgccccgcagccagcaagcaccagtcttgaccgacggcgcaactgctttcgccccgttcccctgagacgacccatccccgcctgagcccccgccatcggagagcccccgtcatcttttcacccgccccgccccccccctagccagaaaaaagattcctacttccctggattaccccctggaaggaataatcacacgaggaaatgagaacaataagagtagggacagggaagaaatcacagtttatatagggaaatttgggtaatctctgcacaaggaagaggaggtaagcaaagagcgcgacgaggggtggacgcgaacctccatcgcgacaatgaacacctctggacagatatcggacaccagcaccaactatatacggagcggtgaagaaggatttgctgaggtagcgagccgaaggcaagtctgcagcagtaacaataccctcaatgagtcgaaagacaaccaattgttgttcctcttcgcgactgacgctccatcgatgcctcctcgtgagcgagcgtagttttccacgagggccgaagttaaagcatggacatgcgtgcagaaggcaggtagtgagaatatataagagagtcatacaataa

SEQ ID NO: 743 - DNA, 139530 bp, Unknown
  Metagenome-assembled genome
ggggacgacaacgattaataggcagaaaacaaaataagttggttaaagttcagaacgctgatgaagcacgcgtttgggcttcttaggtacttacaagtgatgggtaccaaaatctatctaattaatgcagcaatcaaggcttttcaaaaaaacatctaagagcagtgtgaaatgccacgaatgccggaaaacagagcgaggcagcgtaatggcagttctaaacttaaggctatgttgttgaggatagcagttatcaaatgaaataccaactgtggcgttgccaacgtcaacgtgctaaaacttgtttaaaatctaatatatttggtatgatagttcaaaaaaggtgattagtcatgaactacccaagcaatatttcgccaacaatttgaactcattcgtcccgacttagagctgcacggcgttcaacgaggcctcgaaagtatgatctttatgaggtgttctgcagttgtctatgttttaagaactggctgtcaatggcgcgagtaccagtttgattttcctcgctggcaattggttattactattatcgggtatggtctgagaacagatatgatgaactacaatcttagatcagtgtttaaaaaaattgtttaccctacgggaaaaaacaagtcacgctcggctagaacatctttcataatcattgagccacaaagcgttaaaataccgatactgctgagcatcgcggctacgacggtggaaacgcatatccggcatcaaaccccctacggttgatattaacggcttaccacaagcaattcacatcaccacgccaatgtttccgaccgtaatggagccagtgccatgttagctctaaattctgggcattacagcaagttaaatcggttcttgtcgatggtggctacactggatcgaattttgccgctgatgtttacactaatttaaacgccaccgtccagggtggctaaacgcaatgagcttcataaaattcgaagtactgccacaacgctggatcgttgcacgttccttcagttggttggataaatgtcgacgactttggaagaactgtgagcgtaaactcaattcaagtcgtcaaatggttatcttagcgtttctggtattactcctaagaagattttaaacaggttctaaggtgttggcaaaaaatgaacgagaattaattattttgatgcatattaaaaatcagtccgtcgtattctgccgtgataaaggcagagaatgcgatggactgattttttgaaaccactaatttaacaagctaggatcaatctggcggtctttaaagtagtacagacggtcgtgatcattaatgtgtcgcaagatatgggcgggattccccacggcgacgacgttatcaggtaagtctttggtcacgatgctaccagcgccaacgacgacattgtcgccaatcgtaataccgggtagtacgatggcacctgcgccgaaccaacagttacggccgatatgaactggcatattgtactgataagcttgttcgcgcaatgatggcaaaatcggatggcccgcggttgcaattgtcacgttggggccgaacatcgtatagtcgccaacgtaaatatgggtatcatctaccagtgttaggttaaaattggcgtaaacccccttgccaaagtggacatggtgcccaccaaagttactgtgaaacggtggttcgatgtaacacttcgggccgatttctgcgaacatcttgctaagtagaatttggcgcttggttagttcgctgggccgagtttggttgaaatcatagagctgatcgagatagccaaattggcgtttttcaagttcagggtcgttaggtaagtagagttcgccagtatgaagacgatcgttattattggtcattaattaaacttcctttcgtggatgatggctgccggtaatcaaggctaagccacctaaaatgagcataatccaaatgagaacgttggcggtgagcgtctgcggcccaagttggccgagactgttccagaccagtggcgcaaagaaagcgctgataatggtggcaatcgtcaggtagctactcaggacgttgacttgaatggtatccaggccagtattgctagtgaagaccaaatatggcccggtgtacgagtaaataaagttgaaaaatacggcagcgccaatagccacagttgcattggatgccaaccataatactaagactgaaatagctgctccggcatagcctaaggttaaggtgaaccggtgtaaatagcggtatagatagccaaaggtgagaccagccagcaagccaccgatgttcatggctgctaaggttaagttgatagtggcagcgttaccaaaatgacgggcgctaaagtaactcggcagctttaattgaacgccccagatgagtagataggtgataaaggtaagtcctagtaacgtccactggtgccgtggtagttgtgtcttttcagtgcgtgcgtgattagtcgttgttgatggaacagtgggttccggtacgaaccacgccacgcccccagcaacaatcaccagtagcccgtatagccaaaagacggcatgccaactgagactgatcagcaggcctgctaatcctagcaatatcgcgttacctagggctgagaggcccgtctggtaacctaacagtcgggcccgtaaatcacctgtaaagctgtgggtcaacaaactgatggcatgtggtgaaaagaggccgacgcctaatcctaatccgagccgactgaccatgattacggtaaagttagtcgtgatagcgggaatcagtcccatgatggcgctgatcaagagtccactaatcacgattggccgtaatccccaccggcttgttaatcgggggttgagtaacaaagtaatcaatgcgctacagttggcgatggtgacgagccattcaatcagcgtagtcgggacggtgggaaaggtccgtttgagctggggaatgattcctgtaataacggtagtgatgcctgttacagtggagaggctaagaatactgatggtggtggtcaaccgtggctgcatggcttacgcctccaaccagtttttgatccactgtaagacgccttgttcttggtttgtacctgtcgtggcgttggctacggctgtcacggctggttgagcattcgccatggcaacgccgcagccgacctcccggagcatttctaggtcattgcccccatcgccaaatgcagccatgtctgcgaggtcgattccgagaacctgtccgagttgtgctaagccagccgccttattcatgccgggttggataatgtcgatgtcgccatgaccactgctggttggttcggcgatacccgtcagtaactcgcgtagttgcgtcacaatcgctgtggtgcgttctggtggacatgtgatggcgaacttcataatgtcatcatcaagctggtcgtaactttcaacgacggctaagtgatgataataatgtcgcatttgcgccacgtgctcaggattagtggtcgttagggtgtaggcacttttggcaccgcaaaccagtagctttaaatccgggatggtttgaatcttattcagaatcgtctggattgcgtctggctgaaaggcgttaagtgcgtaaacgtggtcggcatcgcggatataagccccattttcagcaaggtagatcatctcaggatagtccttgaagaaggacttgagttggaaatattgattgccgcttgcaatcacgaaccgtacgccccgtagttgtaattgttgataaagcagtgcaaattgagcttcgtcgtaagtcatgtcgtcacgcaaaaagctgccatccatatcagttgccattaatttaatcatggttaaaatctcccgtcgtttaattgatagccgtagcttaccacgaaattcagatcacgaagggacatttttagaggcaactagtatcaattcggtgataccgggcataggcttgacgatagtcagtaggcgtcatacccttccaagatttaaaattccgattgaacgtcttactattcggaaagccgcattgcatggcaatatattcaatcttatggtcggtctctaacaggaggcgacgggcgttcatcaatcggatcagtcgtaagtatcggttaacggatagttgaacgtttgcattgaattgctgattcaaagtggtcaacgaaacgtgaaattgctcggcaagggtattaccatcgatgggctcagcgtaatgttgattgatggcagtcatgaccgtatccgttaatgtcaagttagggctgaccgttgttgcagtcagaggaacggtaaacgtttgacccagagtgacaagtaactggtaaaagtggctgagaatttgtaatctcagcagatcggtcgtgggggtcgtcaacaggtcgtgaatcgtgactaattgttggcggacatcggcgtaggcttgtgggtgagttttcgatgaggccgcgccgttcaatgtcaattgccagttcgcacttgccggaatttgagtttgtaagaaatcgtcgtcaatgatgatgccgaactctacccagtcaacttcggtgggcccactagcgctgtgaaccacgcgtcgattagtagtccaaaggtcaccaggccgatattcattcgtctgtccatcggtgacgaattttaaggtcgtaccgctgacgagataatttaactcaatcccttggtgccagtgtggggcaacgttgatatcagtcaatggatcatgttcgtaatatttaaaggggaggcggggaattgtctggaccgtctcgtgtaagattttcatcactaaacctcgcttcaagattttgtaaaatcgcaccgcttcctttcaaaaatcaaccttgatggctgacgcgctatgctatattagaattatagttcgcgatgagcggtggcatgacttaattgtaaccgtattcgcagttgaaaggaacgaaaacccatgacaattaaattaattgcgattgatattgatgacacgcttctggattcaaaggggcaattattaccaagtacgattgcggcagttaaggaagcccacgaccaagggattaaggtggttttgtgtaccggccggccacttgctggggcgcaacattatttagatgcgttaggccttgctggtgatgaccagtacgtgattacgtataacggtgctgtaatcgagagcattgctggccggatcgtcgccaaacatttagtggataatgcgcactatcggcaattaaccgcgtttggaaaacaacatcacgtgccctttaacgtgctcgatgcggacagtacgatctatacagctgaccgcgatgttaactgggtcacagttgtacaggcgtgggaaaacaaagctgggctgttgattcgagaccctgacgatttaccagctgattttcaaattgccaagggggtctttgtaggtgaaggcccgcaactcgatgccgtagaagcgcaagttaagacgacttttggtcgggacctgtacgtggtacgtgcggcaactaacttcttggaactgatgcatactggtgtcaacaaggggcaggcagttcaggatttagcggcagctctggaaatacaaccggacgaagtgatggcactgggagacgaacagaatgatctgccaatgtttgctttcgccggaacagctgtcgcgatgggcaatggcagtgatattgctaaggcacacgctgatcacgtgacggctactaatgatgcgaacggggtcgcagctgcgattcggcagtgggcattatcggattaactcggatgattatttttagcgaaacagttgacaagactacgcaatgagtttatgattgcaaatattaaaaataaatgagactaaacgtgatgatcaggagagtaaagtcagggtaatcttaagcgagccgctggatggtgtgaagcggtggtgagcctggctggaaagtagcctgagaactgctaatgcgacgagctggagtgttagctgggtgcccccattaacgggccaacgtatcgtcagttaacattactgtttggggaaacccgtcatcggtgttggtaattggccgtacgcgcaaaggtgacgagctgcggttcgtgacgaattaaggtggtaccacgcgttagcgtccttacaaaatcaattgatgattttgtaaggacgcttttttagtcccatggcagttgagaggatggagacaatgcgcttaacaagtagtgatggtggtttgtatcgagtgctcttactagtgattgttcaaactggttgatgagaacgacgcttaacggaggagagacgactatgcaaataacgcgaaaattaacaatcaaacattacatcattattggatcaatgctctttgggatgttttttggggctggcaacttgattttcccaattcacttagggcagctagcgggggccaattggttgacagctggttggggattcttgctgacagggacactattgccactgttaggaattatcgccatcagtgtgacgcacagtagtgggatttatgagctagcgcggccaattggtaaacgctacgcgacgatttttatggtactgacttgtgcgactttggggcccttgttcgcgacgccgcggacagccactacgccgtttcaaattggcatcgctagccatgtgagttcggcacaggcacagtggtatttattagcttactcattgattttcttcagtatcacttactgggcagctcgtaggcccacccggatcgtcgatacgatcggtaaattgttaaacccagcttttctgattttgctcgccttaatttttgggattgccttcagccggccgttagggaccacgaatgcgacaccgaccgcggcctaccaacacggcgcgttcttgaacggctttttgcaagggtataatacgatggatgcgttagctgccttgttgttcggaattgcagttgtcaccacgattcggggccttggtcaacgggatgccggagcgattgctaagacggccgccaagtctagtttgttgagtattagtttagaagcagtcatttatcttggcctgatctggattggcgcgacgtcgttatcgcaatttaagttgtctgcggatggtggcattgcctttggtcagattgccaatgcttttatgggcacgccgggtgcgattgttttagcgattatggcgaccttgacgtgtctgacaacggcagtgggtttggcgacgtcgtttgcggaagccttgcacgctaaatttcctaaaatcagttatcgcgcttggaaccgcttggcctgtggggcctcatttctcatcgctaatattgggttggatcaaattattgcatggtcgacgccgatgctgatgttcctgtatccgttggcgattacactgattatcttagcgattgcctcaccgctatttcatcgtgatccgctcgtttatcgatggacgacggcgttaactttgattccagcgttcattgatggtctaggtgctgcaccagccctgattactcggttaggatgggttcaaacgattcttgcatgggatcaacgctacttaccattagctaaactaggatttgattgggcacttcccgccattattggtctactgatcggctggggctggcactatgcgcgccgcttccagaacgcccatgcttacaagatgagccaggactaaaggtgtatgatagatggtaagacttttgatggatgggtgagcacatggattttttgggaatactttgtttgttgattttggcgacaaccctcgctgggcactttgctcaccgtgcggggattcctgccgtgattggtgagattctggtcggggtgatattagggccggcactacttaactgggtccatttaacgactttagttcaaacgttctcagaaattggggtcgtggtactgatgtttatcggtggactggaaagcaacttagcacttttacgtaagtatttacgccctgccattatcgtggctattattggagtgatctttccagtcgttattatggggcttgcgagtcgcttctttcagtttagctggtttgaatcactgtttatcggtgtcatcttttcagccacgtcggtttcgatttccgtggaggtactaaaggaatttaaagtgttggatactaaggaaggagccacgattctaggggcagcggtcgctgacgacattatcggggtgattctgttgagtatcatgattgcaatgatgggtggtcagagtggcgttgcccagactaatctcggtatcgtgctcttggaacaggttggcttcttcataggggtcttcatcgtgattaagtgggttgccccgtatctgatgcgcttgagtgatcatctgttgatggctgccagtccaactattatggcgattattatttgtttagcgttggcatggttggcagaactagtgggcttgagtggtgctataggtgctttcttcgccggagtcgcaattgcacaaactgattaccaacacgtggtggacgttagtattgaaccagtgggctacacgacgtttattccattattcttcgtcagtgtgggtttaaatatgacgttcaaaggggtctggcaatcgctaccgttcatcgtggtcatgacggtgctcggtgtgttaactaagttgtggggttgtggactgggcgcgaagttaaatgggttcagtcgccatagtaattacttagtcggtgccggtatgatttcgcgtggtgaaatggcattgataacggcacaaattgggttttcagcgcacttactatcaaacgattactattcggatattattttggtcatcattgtggtgacgatgattgccccgttcgtcttaaagaatgccattcatcgtgccggtcaggtgactgcaacacatagcatcatagaagagcattaaccacatagattgggcggaagttaagagccgcttggacgccgtagtatggactacggcgtttttttgaacctgtgtgatttaacggaatgagcgagggtggtacattagtgagttgacttactgtcgtggtgttggtggtgggttgtacgagaatagctaaaaatatgacggttgtagaaatatcgtccaataaatcgggtaggcgttatattaaaagtgtggaaggtaattaagaattgactgaagaatcttggattatgctaaaatgaaaaaggtaacggatggtaaggatatggtggggagtaactattataaaaagaagacgacgttggttccgaaagctataattggtggataggtgatatcagaaggagcttgataaatatggaagaaattatatcttttgaattttctaatggttcgaaacttttagatagtaatgtctatgaatataaagtaggtaaagaagggactattaaaatagactttccagatagtaatggctttgtagctgttcataaaaataatactgaaacagcatatattaaggccccttatatgaaattttgcacaggtagacatgcctagaataggttatgtttaaatttttgaaaaacaaaataatggcagatttattcgccaaaatagcccaaaacctcgttaggagattttgggctattttttcataggatgaaaaagtaaacgtcagtcttacatcaaccccgattaaatcgacagatgaatgatgcttttaccttaaggggactatagcaaacttactcgtatttttctttctagctttgaataatcatttataatccgctatcgcccagcagccccatcactaagcccttgattaaatgagctaatgattgaaggatcactaatcacatagattgcgaaaacgacaataagcgctaccagcaagcttctcactgggtatttcttaattatgtttattgttttattgagcattaacgtgtgccttaccttttatatttaaattaatgtgccaataattaaaacggcgtctgagatccaatggacatagatgccgctccgtaaagtattggcagatcgccatgaagcagttattggataacgcgtaataccgacgattaaaggataaatccagttgaaatgataatgtggaaggtgcagacacgcaaatacgatgcaccccaatacattgataatcggccacgcatatttttttagttgtgtttgcgataataagcgaatcaacggaagtgaaatagaggccattccgacttcctcaccaactagtgatactagtagcgtgaaggctatccatactctttcaattaaaggataatctcgcccagttgaactagttgtcaatgttgtattgtgaaatgacaataaagcatgcgaattaatgatagctataaccacaatcgcagtgacttccagaacaagcaataaaagcacatacttaactactatgcgccactttggcgagggtaacggttgaaaaaacagttttaagttagaaaaaccatatagcatgactaaactaattattccggctgtaagcattgctaaccaatcaaaataaatattaagaaagatcgcacccatataaccagccacaaagagcactaacactagcgggtaatatttttctttgaaatcaatttctatcacttattataatcccttgaaccaccaagcacggcccgttcaaccgcgccaaacgcataaccaatagcgtatccaattccatttttacgactccgacggccaccagaaatattcttttcagcgtcagcagttaattcttcaaattcatttaaaacagttaatttaattttcataatatacgctccttaatttaagtccatttattaacgacggattgctctgccagcttcgccatcataaaatccttttcttaaactagaccagaaatttttccaagcgcctcccccaacaaccccgttcaacttattattagaaataggtgcaaatgcatctactacatccaaatccttaatcattttgttcacagtcatacctctccctttactgtagcagttaaaaatggttctatgcgctacgtatttttaatgcacttattaatatacgctacaatttaaaaaaaattattttaaatttgttatcgtactatttaatcgatttaacgtaacttgaaagttgaatgtctgacgatcccataacattaatgggattatttttgctatgacgaattgttaaattaagtgcaatattttaccaaagaaaacttcacttggcctttttcatttcaagctcttacgtggcgattatttaaatctatgactaatgtgataattccttgattgttgaggtcgtttaaagtagttcttttttggaaatgtgttcgcaaatcaagtcgttggtatttcgttagttttgcggtgtggtggtctgggcgcgaagttaaatgggctcaggcgtcatggtaattgcttagtcggttctaacatgatctctcatacaccggttataaaaaagctattcatcttgccggtcagatgggcacaacacatcggactggagaagaaaattcaacacctagattttggcggaaattaatggccgcttggataccataattttgagcctaggagattgaatggcgaagctagactggaatctttgcgtgttgactttaattgttggttaaacgtctattttcgtggtatcgatgaattattgtacgataatatctaaaaatattacgtttataaaaatatcgtacaatgattcgactaagcggtatattaaaagcgtagagagagtgatatcaagcagttcgattgaattgaatgaaagcgatttcttgtgtgtgagtctatattaaaaataattgttgtttagaaagcagtgggaagatgcttgaaagaattacaggatttattattatatgttttgctatttggcaaatttatactgcctatttagcatttaaacaggtaaagcaggttggcaacaaaagtacttcaccctttattgcgttgggtgtctggtcaggattatcttttggtattttgatggttgcgtttggaattgcattggcatttaatgcgatttgatgatattcactgaagggggatgtttgaaatggaaaatttaaagttgcatttcaaatgtatatcgtgaaatgcaaacgggacttagatgtttatcaaaagttgaatgctttaaggaggaaatgcaattatgaaaagtttagataaaattgccgggttaggtatcgaaatggcagaaaaagatttgactaccgttgaaggtggaaaaaactattctaagacatggtggtacaagagccttacattgctgggaaaggtagcagagggaacttcgagtgcatggcatggtttaggttaaaaataacagctattaggaattagcaaaataatgatggactagtcaatagtgaaatgattggttcatcattatttgattgtattcagaaagaacaattaggtgggacggtgttgtatcatgattaaatttaaagaacggggaaatgtttcatttagcaatttcaggctgaaggagcatcagtgtgattatgaaccgattattggattaataatggttaaaaatcaagaaaggcggatactgcaaacgctagaatcaattgtgaacatctgtgatcaaataataatggttgatacaggctctagcgataacactgttgcaattgtagaaagtaattataacagtgtgttaataaagcatgtagactggaaagaagattatgcagccatgagaaataaatgtctaacctttgttccaaatgatacttgggttttgtttgtagattctgatgaaatattttctaaagaatataattcagaagaaataaaatcctttttatatgaagttgataaaagattcccaaatcaagacaaaatttgcacagtaaagcagatgcaaccggatcgcccaacatatgttcgtccggaacgttttgtaaagaaaacggagaccctttattattttggatatgtgcatgaagaacctagaactaaaagaacagaaaaattagtgaaaattgacactgatttagaactcatgaacaatggattaacaaagggagaatatgcaaagtttaataagcaacaacgatatgcgatgctcttgaaaaaaaacattgctttagaacctgataatccacgttggacaagcttaatttcaccaattgatattcaattagggctgtttgaacatgacaagtatgtagagaagctgaaaaaagagattcttaaagatattcatggtgatatcactgaaaataatgtgaaacaaggtgagtatcttaattacttgttggaacgatactgcattgagctagtgcattcagaaaacatggaactagccagtaagtacattaagtttagtaaaaagaaatttccctatgacgtaacttttatagttttagaaatgactattttctttacgagtttagaacaagcaagtttgagagagcttaaaaagattatcgattttactaacaatacggattttaatattattgacagtgaatcagaggggtccgaagatgcacttagcgctgttgtaatcaaacttttactgttagtcgaaaagtttgatcaggcaaaagcagtttataaaactatcagcgatccaattgccaaggaattattgaatgatgaaaagaaaattttagaatcctaagtaggatgttcttaaagtggggattttgtattgaaaaataacgatataataactaaaattgcgatttgttttgttcttgtacctatcgtgttgatagttttaccatatctaattagtccgataatttccgaaaagtatggacaaatgacagtggatttaattatttttttggttgcaatagttttgagtcaaaatatctggcatataaagataagctttttaagcttaaagaagcctttgagtcaattatgccagttaataccgagcattttatttttgttatttactcgatttagcacacttagctcaatgtcttttcgcttgatagatgcacgaatcatactgacggtactatttattgcattggcagaagaaagtgtgtacagaggcctattaattccgttaagcttagttttcacaaaaaacaagcaatatacggccattgttattagcggtgtaggttttgcgttggcacacttggtcaatatcgtaaatagtccctggtcgatagttatgcttcaaatgctgattgtttttgcaagtggtctgctttggggaactttatatttaaaaactaacaatttgtcgctaacaattatgttacatttcttagatgacttaccgttgttcttaatgaaagaaacctctgagcttgttacacctacccgccctcaattaatttctgcaataatggcgtatctaatagttgtgggaataattggaataataacatttttacaagttgagggattacatttatggaaattgaaaaagtgatttatgaaagactataaatagtatacaattttattattacttaattatgtgacgtggttatttttaatgatttataaatctactagggggatgtgattgaaaaattgcatttccctaatttgattttttaatgtgttttgttaattgatgctttgaaaatcaaaattgtgctaaccctgttcctagagataataaattttttctgtcggaatttaatgtttattataggcactcataaatataaattgttaaattggttgtattttgatttacaatctctaatcatttttcgtctaaaactaagttaatgatgaaattgagaatttgtgctgttaagaatggagtgaactaaaatgaaatcctacaatatgaaattgaaccgcgatttttataaagcatattctttttggctaggggtgttagctgtgattggtcttgtaggagatgttttattaaagtacaataccgcggttagcccgtggataatgatattaattgcaatctatttatttttgagagcctttacaagtaagagaaaataaatattattaacggtatttttggcattatttaaatttacttagaggaaatgatttgaacttgttcacgaaaaatatattaatctaagtacagtactaatgggagtttatcttgaattctttagcgctacacttaagttaatgttattttatcctctaagtatgttcaaagtaatcaagatctattcaaaatagtgactttgacattcatcaaatattgattgatagcatagttggaatttcatggtgattcacgtttaaatttaaaaaatgtacgttaatagaaataattcctccgtacttcaaaaacacattatcctaaaagcgaggtgattattatgaaaattcaaattaaaggtatgaagcaacttagtaataaggaaatgcaaaaaatagtaggtggaaagagtagtgcgtattctttgcagatgggggcaactgcaattaaacaggtaaagaaactgtttaaaaaatggggatggtaattgatttattgaataactgtttttcaagttatatttcgtatagatggcgtaaggtggggcatttttaaagagtcacaacacttgaaaagaagactataaaatgataattttgctgataaagtaaactaataatcattattttagaatagttagataatgatcgaataaaaaatactttagaggtagtagcttggttgaaatcagtatcttcgatagcgttattcaatcgtttttcatttatcttggcattatcttggtatataacttcatcttcagtaatacgaacattaaaagaatcatttattcgttgattttattactagtgctgtccttagtaggagctatcttggatgacactacatcgctaattttggttttgggggcaattattaaggaaaagtgccaaccaaaaataaattattatcatctaaatgtattcttaatgttgatttctagtcagatagtaattttagctttggcttcttatttaagtagaggatttctgtatatctacttagatgccgataaaatttctggcttgtcggagtatggtgatttattcattggtattgaaattattgtgatgtatattatcggatttttggtgttcaatcttgtgtacaaaatggtgagacgatacacaggctcgtttgatataagtgatgacgaaagaataaataggcatctattcattatattgttagctttctttggatcaatagaaatgttgttatttattagcaactttcaaggtgtaacagctacaattcaactaactttactgttgacatttgttttgatgcttgggcttattagttggcaaacattagaaacgattagagtatatgcttggcaaaaaaagatagcagctgaaaaattgcagaataagcaattaaatgattatcttaagagtgttgagcatcaatatctagaattaagaaaatttaaacatgattataagaacctaattgctagtttaaatactcaagataatataagtgaaattaaggattatttgaccgactatacccagagcggagaattcagagcaagcctaaatgacggtagcattgcaagtgttcagcatctgaagaatgagatattgcgcgggttagttgtacagaagtttttttatgcgaaacagtgcggggttaagttgacgattgaaatagctaacactgactttattctcagtcatggtgttacagtggctgtacgtattattggtaatttattggataatgccattgagcaagcccaaaaaatgactgataaaatagtgacagtagcttttaatgaaattgataacaccgctgaaattgccattagtaatcctatcgattcagattttaatcagcatcagatttttgaaactggttattcaactaagggtagtaatcgtggcttaggtctgactaatgtgcgggatcttgttgaacagcagaagggtttctatatggatattgaaaccaagaaaaattatgtcacaatgacgttaattgttacggaggataaataagtgtttccaatttatttattagaagataacgaggcccaaagagtagagtatataagtattataaagaatataatcatgattaaagaatatgatatgcagttggtggtggcgacaggagatttacaagagttaatgaataatgttatgaattctaaagaagggctgtttttcttggatatggaaattggggaacaaactcaggccgggttgaatttagcagatgaaattcggcagcagttaccttgtgcacaaattgtatttattacaactcatgaagagttatcttttttgacactggagcggcggattgcaccgttggattatattttgaaagaacaaggccttgatgatattaagcaaaaaatagttaaggatattgatgcaactcaaactattctcaagacagaaactgtgcagcataaggatattttaggttataaaatcggaacgcgtttcttttcagttcctattaatgatgttattatgctgagcactaataaagaacgaccgggtagtattaggctgactgccaaaaataaagtggcagattttccaggtaatttaaatagttttgaaaataaatactcacaattttttaggtgtgataaaagttcattggtaaatatagattatgttgatagttatgattatcaaaaaaaagagcttaccatgatagataacattaagtgcagtgtttcgtatagaaagtctcgggagcttaacaaaatattgaaaaagaaataggaaacttatcttttatagccagggcaatgaatcgtagtatcttgttttgagatagactgcttttcatggtaagagcaagcaaacaattatatttttgacaattttggaggaagaatgattgtttccaatttatttatacgaggataatgctgagcaaagagataattattgtaagaccgtcaataatacaattatgattaatgagtttgcaatggagcttagggttgcaacggatgatcaaaaaataattctagcagatttgaatcaacaacaagatggccttttctttttggatatggaaattggtgaggacaaacagactggacttgaattagccagtcgaattcgggcaacgataccattggctaaaatagttttcattacaacacacgatgagctatcgtttgtaactctggaacggcggattgcaccgttggattatattttgaaagaccagtctgctgacctaattacgcaaaggattattaaggacatcaatgtagtacagaacgaattaaaaaagactaatagtcagcgcaaagatgtttttaactataagttaggaacgcgatacttttcactcgcattagatgatgtgattttgttgagtacatctaaactgcgtccgggcagcgtacaactccatgctattaataaggttgctgagttcccaggaaatttaaatgcgctcgaagaaaagtatccgcaatttttccgatgcgataagagctcgctggtaaatttaaatcatttgcgaagttttgactataaagaaaaagagttgttgctcgacggtgaaattaggtgtaaggcttcgtttagaaagtcgcgggaattgaataagttgttgagagacaactagttttttaatattatttagagcttctgtcagtgttatttgacagggctcttttgttatgaatatgaaatctgattatataatataggcgctgaagatagttggagtagggctctaattgtgatcttatgagtattaaaatgactaaaaagtaagcacagtactcgatcgtaaagtatattagaatagcgttaagacgtgaaatttagttagcgatatgactagctcttagcgtaacccaaaacttcagagataattgaaattgtagtgctgcaaacaataatttataggaattcagaatggatgattactcgtctattttatcttcaatatttaggatactcaataacttccaatgcttagaggataggataaacgtagcaatgccaatgaataaaatatttagaaagagcccctttagaagagcttccattggcccgttaatgggtgattgagttgggtcaataccttgagaatagaaactagaaaaatctatcaaccaatggacactaatggcagccagtaagcttccggtttttaaatagattgctgcaagtaaaatacctaacccaataacatagagaacctgacacaatactgaccatacgggctgtgataaaaggttgaccaaatgcatagccgcaaaaataagcgaagcagtcatcatcgaagcgatggtggcctgcaatgtggcaaattttttaaggtttagtgctaaaagcgttctgaatatcatgccacgaaaagcgtattcttcagttatcgctacaatcaacgaaagtaataatgagattaaaaattgatacatgtggtttcgaaagaaaataagtagaaatattattgctaggctcaaaggcagactattcttctttaatattgacatgatattaacgggtagccagtggataggttgcttaacatatcgcctattcagaatgattatcgcgattaatataatagattcagttaatatgaattgaaagggtccgtcttttattcccataatatcagtcaaaggattcattaaaaagagcactattaggtagtaaatagctgtgattattacttttattaatggcatagttaaaattccccccatataaactaaaaaggctgagcactgcaggcccagtcataaatcgagtgctttcttatagtgcttaaacttgatggcttgaactatccgtggatgaatcctcggacagcgctaatgacccaatcggcaggcccaacagcacttttataattattccgaacgccacgcgcgctataggcatggaaaacgccacctgaaatagcatttaattcacggtcacgcaaaactagaaattttttcataattgttgatctcccccaagaaaattaacgaatacttttcaaaataccacgaatgcctgcaactgaaccaattgcatcaacaacatgtcgaacacttttaccaaagttataaccgccccgattaaaaccaccagatattttggcaagctttttttgcggcaacctggaatattgtaacttctcaaactgtagcataaataatcccccttgtatgatgttatttggaacaaatttagtttaatttatttttttaccagattgttgaaaaaattataaaagtaaaaaaacgttctcttaacgtcaaataccaatgttagctagttgatgtttaaccgttaagcctgatgaggacatttatcataaaattatgtacgttaatagatagttggcatacgataacatttgttagcccataattaaatagataccgatacttaataattggtgaggggagtacaagtatgcattggagaaactatgttgcgcaagttgacgagatggactgtggggtcgcagctttagcaatgattttgaaaaattatggttcgacaacatcattggcctatctaagaaatattgctaaaacgagtttagaagggactacggcattaggattagtaaaaacggccgaaaagttaggttttgaaaccaaagcaattcaagcagatatgagtcttttcgaggtacaagatttaccattgccattcattgtgcatgttaccaaaaatggggatctacagcatttttatgtcgttgtaaaaacctcgaaaacgcatgtcgtgattgctgatcgggacccaacagttgcggttatcagtatgtcaaaggaacggtttgaaagcgaatggtccggagttgcccttttctttgcaccgaagtcggaatataagccagttaagcaagataagggctcactatggggatttattccaagcttattaaagcagcgccgactggttattaatattgtgcttgctgcagttttaatcacgattattagtatctgtgggtcttatttcttacaagcggtgattgatacttatattcccaataatatgcacagtacattggcagtggtggccattggtctaatcgttttttatacctttcaggctatctttacttatgcccagaattttttattggcggttttaggtcaacgactttcgattgaaattattttaggctatattcggcacgtctttgaattgccaatgagtttttttgccactcggcggacgggggaaattgtttcgaggtttacggatgccagtaagattattgatgcgttagctagcacaattgtttcgctgtttttagatgtcagcatcgttattattatgggggcaatcttggtaatccagaatatgacacttttttggattacgttactctcgttgccaatctacgcggttgtcatcttagcctttaataaatcctttgaacgattgaatcaaaaggaaatggagagcaatgctattttgagttcagccattattgaggatcttcatgggattgaaactgttaaggcgctgaatggtgagacggaacgttatcagaaaattgattcagaatttgttgattatctacgtaagagtttagcctatcttaaagcggatactttgcaacaggcattaaaactgtttatacagttagtcttagaagttgttgttctatgggtgggcgccaatctcgtcattcataatcagttatcagttggggagctcatgacatataatgctttattagcctattttgttaatccactacagaatattattaatttgcagactaagcttcaaagcgctaaggtcgctaacaaccggttaaatgaagtgtatttggtcgctagtgaatttgaggcgtcacggccaattcataatgaaagtcaattaaatggtgatattaagttacaaggggtcagctatcgttatggttacggtgaaaatgtcttagatgatgttaatttgacgattcgacaacatgataaggttgcaattgtggggatgagtggctctggcaagtccacgttagttaaattgcttattgatttttatcaaccaaatagtggtgatgtcatattgaatggcttcaacgttaagaacatcgataagcatacattgcggacccatattaactacatcccgcaggaaccatacatcttttcagcgaccattgaagaaaatttaagattaggtaatcgcagcggtattactgagaaagatattgcgaaggcttgccaattggcgttaattgatacggatattaataaaatggccatgcaataccaaactaagctagatgagaatggtaatacactatcaggtggtcagcgacaacgattaacgattgcgagagcgttattatcacccgctcaagtcttgatatttgatgagtcgacgagtggactggatgcaattactgaaaaacaattaattgataatttagtggcaatgactgacaagacgattatttttattgcccaccggttgtcgattgcaaagcggacgaatcatatcatcgttctgcatgatggtcgggtcgctgaagaggggacccatgcggcattgttgaatgaacatggttactattacgacttgatcaatagctgaggggggaactgaataatgagaaaagacctgctcgaaagtggcgagttttacgggattcggtttcaaaatttttcaacattactaattattccagtgacgctattgttaattggtacgattctgttttcactcgtagcgaagcgcgagattgttattaatggtaccggaactgttcaaccgaccggaacggttccggtgattcaagcgactgtcaatagtgccatcaaaaagaattatttagttgaaggtgcgcgagtgaagaagggtcaaaagctattagtttatactaacgtttttaatcgcaataaattacgcgaagataatgtcagcaaacggcaattgcaacgccaagtaacagccttggatcattttaaagatggcatcaatactgacagtgatgtttttccaacgaccgatgaatttgggtaccgagaactattgcaaagttatttaaaacagcgtcaaatctatttaacagagaatcaaatgttggcagcgaaatcgagcgctgctagtactaagaaagccacgctaacgaagaccgcgcaacaagtggtatcaaatactaagaccaatctggatgcttatcaagccttatacaatgcggtggctaatggtagcaagtatgccaatagtgccaagtatgggtctgtttttaatgagtatgtcgctaagtcaaaggaggccaacaacgcaaacgataaaaaagaagttaaatctgcaacgttagcagacattcaacagcagatagatacgcttcaggattcgttgtcctcagctaaagtgcagttagaagaattacaagactttgatgatacgaagtacagtgttgagactaacaataccaaattagccatgttaaagaacgatcagttaagcgaagtcgctgagaaacgaatgaaagccgagcaagatttacggaccgtgaaagcagatattgatagcttaacgacacaatcaaaatcttacacgatcaaggcaaccaaagccggcgtcctacacgttgcagacaattaccgtggtgcaaagtacgttagttcaggagctgaaatcgctaaaattttaccgataatcaagcaacaacggcgagtgaacgttaagctatatatttcgacggcagatatttcttccgttaaagtcaaacaagccattagattcaaagtcacgcggaacgtaccgaagccaattattttggacggtgtggtcacaaagattggggtctcaccagtcgaggagagtaaagcgactttttatgaagtgacagcggccgttccgattacagccgatcaggcacagttactacgctacgggatgattgggcaaacggcgattattacgggcaaggtgacttggtttgattattataaagataaggtgctggataataattgatgattgaccatcagtactaactgactaaatatcactgtggtaaagtaaagttatctagaagcacatatatcatacgaaagaggtaagtaatggcacactcaaataaacaattcatcattaacctagtcattgccagtctaatcagcttagcattggtgagttttagtatggcaccggcgtatcttttcctaattaagaataattggctcatgatcacgattggttttgtaatctatgccttggaagcttgggggctatattggctttatcggcatacagcacgagttaggcaattaccaagtcgcgacgttgaagtcccgggtgaacattgcacaattagggactgtgattattgcgatgctgacaatggtcgtgctcattattgttgatcttaaattgggcgcgatgctaaatattcccgagaccagcaattccaggtcgttggcatggatgctcggtgaagcaccgcttcccatgattgtttcggtcgtgatattttcccccatctgtgaggaattgatttttcgcggtatctttttcagctacgcgttaacgaatcagtataatcaccgtaattatcagatgattgcggttgttattaatagcttaatatttgcaagtgtccatgttgatgcaaattgggagccgtggatttattatacgttaatggggagcatcttggggacaacttatttgttggctaagcgcgatattagaatgaatattctggtgcacatggggactaatttggcagttttcgcgttggcggctatgagttaacgttgtggataaaaattaaaacataagaattagtttatccacaggggataacttgggaggcttggtatggttgctcgattgatcagggtatttggttatgtgttagcgggtttagggctatttatattcattcaattaccggtgttagcggatggctattggaattggtggggtgaacgcccgcaacaaatcaacatcggttatcattgggtagcattagtcgttttaaccgttggtgttgcggtcgtactagtacgttgctatcaccattattttgagatgccagtcctgttagggcctttttcttggtcaatgatggggctgactgctttagtggcagtggtggtcgtggtgattcaaatggggataagtggtctgctagtcagtccaactgaaacacaaaatgatgaaatcatggcactgatccacagtccattggggttattaacattagtgtgcacaaacatcgttagccccgtactcgaagaattacttttccgtggaattgttcaaaatacgctgcgacgatacttgccagtattgggcgcgattatactgacaaacgcagtattcgcactcggccatggttatcagttagccagtacggtgggcatcttcattacagggtgcggtttttcatggttagtactcaaaacaaaacaactgagtaccgcaatgggatgtcatatactggtgaactggctggtcacacttattaacatgatgtggggataagtttcagttagtgatatccggtcaaaccgcaagttgtggattaggtaccattggggataattatcaagaaatgaatgtgaaggagcatggtacatcaaaacgtcaaatttattagtagattactacttgccagtttattggcagcaatcgtgatgggtcttagtacggcgcccatcgatattttaacactcaagtataactggataacggtggcgatcttcttggtcgtctacctgtttgcaatttatttattctatcgaatttatctggaatcagttactaataatcattttaagattacgaaaatagctgctaagccgagcgcgcgtcaattagtgattacggtactggcaatggtggtcatgctgattttggcagcggtgcaagttaaatttgttagtgatgctgtctattcaatcgcggagaatgttgctgacttgcaagcattgtctcagcgctcaccgatattgatggcgttggccctgggtgtttttgcaccgatttgtgaggaattaattattcgcggcaatttcttcagttatgcgctggcggaacgttttgatcagccacgataccaactagttaccgttattgttaacggcgtgttgtttggtctactgcgtggcggttttagttgggtgcagttgtcatactatacggttatgggtctcgtactcgcggcaacctacatattatctggccgggatattcgagtcaacagtgtcgtgcacgtcacagctaatctgggcctcatgctaatggcatgaggccagatggacttggcaagtaacttgagtgggttgatttaaaagcccgttagtgaacattctagttacgattgtttggatggagtggatgaaatgttacagaagaatttacggtttattggtaatttactaattgtgagtgtgttgagtgtcattattgtcaatatcagttccttacccgtgtatatttacttgattacggccaattggtttacactgttagttagcttcagtttatatgccgtgattatcgttttcttgtacaacatctataagacgaccgcggaattgcggcaatttgattttcgaccgtggcgaacgcggctaaataaacgggccttgctactcatggtgatcggcgcagtcattatcgtggcgcttgcttttggctatgctaagctgacggcggtatggcacatcactgaatcgggtaatgaacgtgcattagatttactgttgcggaaaaatccggtagcgatgacactcgatgccgtcatttttggaccaatcgctgaggagctgagtttcaggggctttttctttagttacgtcttgtcagaccaatatcttgaccgggagtaccaagcggctaccattgttatcaatgggcttcttttcggttatctgcatagcggaaatagcttggtgccattagcatattacacgctattcggcatggtgctggggaccatctacctattatctaagcatgatattcgtgtgaatagcgtgacacatatgttagcaaatctggggatactctggttggttcctagctaaaatagttactttggattatgctaaagtgaacaaggtaacaggtagtaagaatattgtgaatacggtgataaaaatacaaagttggttctgaaaactgtaattgatggataggtgatatcagaaggagtttggtaagtatggatgaaattatatcgtttgaattctctaatggttcgaaaattttagatagtaatatctatgaatataaagtaggtaaagaaagcgttactaaaatagacttgccggatagcaatggatttgtggctgttcataaagataataataaaacagagtatattaaggctctatatatgaaattttgcacagatagccatgtttaaaaatggtcaagcattagtttcgtgataacgaaaaacgactggaagtagctagcgtaataccgctgggctacttccagtcgttttttaattccagttatactcgtacctgatgttcaatcgtaaataatgtcgggtccaactgggcaattagtggggagacatcaccgatgctgagcaatgtcaagtggtgcatcgctcgtgacgcaatcgtatataagatgccaactgaatccgcatcgggataattggtagcggagacatcgtatgcgaccaccgcgtcaaattctaacccctttgcaaggtagattggcataacaatcacgccttgtggcatggtacggtcgctatcggccatcaacgttgttactgtatagcgcttcaggtattggtagacctgcttgctttctgctaaatctttagttagtacggcaacggtgttagttgccttgagctgatgttcaacttcgctacgcagactgctgagagcggcgtcttcgccatagcgaatcatgaccttaggtaaatcgcctttacgtgtgaacgcttgaatctggtcgccgtcgggtaatagtgctttagcaaagttcgtaatctgttcggttgaacggtagctcttattcaacgtaatcaagttcgcccgtcggacattgaaagcatccttgaggcgttccagtaattgctgtggtaactcaatccccttgaataatgcttgttcactgtcacctaacagtgtgaacttagctagtgggaacgcgtgcttgatatataacagttgtgctagcgaatagtcttgcatctcatcgacaaagatatattgcatccgccggttctgaccactgccagttaggacatcgcgtaataacaatagtggcgcgcagtcaaccagagcaatccgatggtactcaacggcggcctggtaagcggcaattcgttgttgccattggtcagacgtcacggtagtgggccaatcaacttgcgctaagaaatcgttatattgttcataggtgtctaagaagtaaccattatagatcgcatcgtagacttgccgcagtcgtttggtcacgatttgcttaccaatatagaagacttcatcgtcgagtgattgaaaatcaccgcggcgcttggaacctaataagtcgtggtaagcttcgtcgctcaattggtcaatgatatcattgacccagtcagcttgggcttcatcgtcaatgcgatgctttaagcgtttaatcaaagtgttcttgattgctaggaaacggtcagctggttgcaacgctgctggtaaggccgtcgcaatctttgtaatgacctctttagcgaagaagatttcgccattaaagacgatgttggtgaagcgtaattggtcggctggtagctgatggcaatattgatcgacttggcgcataaagtcggcgctttcttgaaaatcgcgaattgccggtgtcagttgttcacgctggcggtcactttcgtagcgctcaaagaggctttcaacggttaggccttgaaaacgtgcactgagaaattcggcaagcgtgacttgacgcatattgcgctcccctaaactaggtaagacttcggagatgtagtgactgaataagcggttgggcgagaataataccatttggtccgcttctagggaagcccgtgagtggtagagcagaaaagcgatccgttgtaaaatggcggacgtctttccagagccggcaaccccttggacaactagtaagtcactagtggtgtcacgaataatatcgttctgttctttttgaatggttgctacaatattttgcatgtaggcatcattttgttctccaaggacggcctgcaagatttcgtcaccgaccgtttcattcgtgtcgaacatattcttgatctgaccatgattaatctggaattggcgtttcttgatcagctcggtcgtctgttgcccggccggcgtttggtactggacctggcccagagtaccattgtagtagactgaggaaatcggggcgcgccagtcgtaaactaagaaattctgttcagcgtcgacaaatgaggcggtgccaatgtataaacgttcggcttcctcgtcgggactatcttgaatatcaatgcgcccaaaatagggtgagttactaagatctttcaagacaccgacttgccgtttcaagatggcttcggattccacggcgcgttcaaccatttgcttttgttgttgcagttccgcgttcgtttcaatccggtcatcgacttcaaacgtgttgacggaattattatcaccatagtttttctgaatgacatcggtttcgtgatgagcctttgccagcaagtcgtcggtctgttgtgcccgttctttaacttgctcgatgactcgatcaacccgttgttgttcgcgttgttgctcttgatctgatgttgccacgtagagggcctcccgtctgataatcgtctaaatcgcttgaacaattttaggcgggtttagggatgatgtcaatcaaagcgcctgcaaattcactgatttatcagtaattgttgtgaaatgtgattatgagtggcactaaggcgtgctagccaacggtgggcaagttcggcagccttacgatggcaaggctgaaacttgcaacctctgactatttattctaatatgattttaatcattctaataaagtgggtggaacgaatgcgtgtcgcactagcacaacttaatattcagtttggagatccggatgccaactacgagcagattgaagtggccattcaacgggcagctgaacaaactgttgacgtgatcgtcttaccggagatgtggaataccggttatgcgttaactcgcctgaatgtcttggcggatgatgatgggcagcgaacgttacaattactcagcaagttagctcggcagtgtcgcgtcaacattgtcggtggctcagtcgcggtcgctcgcgatgggcattactataatgagatgttagtcgtcgatcgtcagggacagttactgagtcgttacgataaagtccaccggtttgggttaatggcggaagatcgttatattaccgctggtgagaccgagaatgtttttgaactcgacggaactgttgcgatgggggcagtttgttatgacattcgtttcccagaatggcttcgtaaacaagcagctcgtggcccccaagtgatttttgtcagtgctgagtggccgacagtgcggcagatgcaatggcggctattactgcaagcacgtgcgattgaaaatcaagcattcgtggttgcggttaaccgcgttggcagtgatcctgataatcaatttggtggtcagtcactagttattgatccgctcggccaaattgtggctatcggtggtgcccatgcccagttgattacggccgagcttgatttaacacaagttgaccaggttcgtggtcagattccagtgtttgaagaccggcgcccggaattatactgaagcgtaaatggggactggggctgggagcacttaactgaattttaatggtgttgaaggaacgcccgcttgaatttcgatgggcttaaacgtggaaatgacggtcggtatgatgaaatggtagcggctagttagcgcgaatgatgcccagaatttattttgacacggtcaggtataaccagtacactagaactaattaatcgttgaagaaaagaacagtaaggcgtccaataacagagacctagcgcgtgctgaaagctggggcggactaatgaattggctttttggagattcggtgaacaccggggacccacccttatcggtcaatgagtggcagagacaagctttctgcaatttaggtggtaccacggtgatgcgtcctaattaactagtattagttgatcaggcgcttttttagtgccaatagaaaggatgaatacaatgacaaaaaaagtgattttaacgggtgatcgccccactggtaagctgcatatcgggcactatgtcggttcattacgtaaccgggtcgcattacaagattctggggactatgactcatatattatgattgcggataaccaggcgttgacggataatgcgcatgatcccgaaaaaattcgtaaaagtttattacaagttgcgatggactacttggcagtgggaatcgatccccaaaagtcaacgatcttagtccagtctcaaattccagcattaactgacatgatgaatcaatacttgaacttagtgacggtagcgcgcttgaatcgtaacccaactgtgaagacggaaatcaagcaaaaagcttttggtgaaagtgttcctgccggtttctttgtttatccagtcagtcaggccgctgatattacggctttcaaggcgacgaccgttcccgttggtgacgatcaagaaccaatgctcgaacagacccgtgaaatcgtacggagcttcaataagacttaccaaactgacacgttggtcgaacctgaaggctacttcccaccaaagggcttgggccgaatccctggacttgacggcaatgccaaaatgagtaaatcactaggaaatgcgatttacctttctgacgatgccgatactttgaagaagaaagtcatgtccatgtataccgatcctgatcatattcatattgaagatccgggtaaggtcgaaggtaacgtggtcttcacgtatcttgatattttcgatgaagacaaggccaaggtcgcagacttgaaggccgcctaccaacatggtggcttgggtgacgttaagattaaacgctacttgatggacgtgttggacggtgtattgcggccaatccgcgaacggcgtgcaatttacgaagctgatccagctcaagtcttacaaattttgaaggatggtacagcgaaagcgaacgtggtcgctgaccaaacgtggcgtgagatgcaagacgccattggaattaattattttaaataaatcatggtagaaaaaagtgcaactgaccgtcggatgtgtgaagacggtgagttgcacttttttgtagacccttaatatatggggctttccggtaaattaataacgatggcccaacgcatcacggttgcgaattaaaaagaaaaggcagactaaattgaaaattaggctgatttcgtttgctttcttacatgaatgattgtaaaaaagtgcttgttaaaataagtttttggcaagaaaaggggtggtaaggaattcgaaagcgcttgctgtggctgcctttagtcataatataaattcattggtataaaattacgaaaaataaagcgttttcatatattctgtgataatataatttgtgggcacaagttttacaagcacctactaatttatcgaaaggaggtttagtcatgtatcaggcaattgcgcaggcaatcattaaatcgataatggcggatgaatatccgactaagttaccaaccgaaaaagtgttaatggcgcagtacaacgccagtcgcaatacgattcgtaaagcgattgatgtggtcttccggcatgggttgttgcgtcgtgtgcaggggagcggcaattttattatcaaacaaccgcagaacacgaagaaagtgctcaacttatcgattggatttgaccagtccgccatggttgagggtggaccattagtatcaaaagttgtcacgtttgataaagtgacagcggatgaaactttagcacaacaagggaacattgcgcttggcgacgaggtttatcgggtggtgcgattacgttatttgaatgacatcttgtatgacctggaagagtcttattttccgcgaacggtcgtcccgttcttatcgagtgagagcgtgcagcattcaatcttcgccttcttgcgagaggcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtctttaacttctccaggacgttcttcgtctatccagatttagaactctactaccataccgaaaatattgatttacaaaactagtacgggggtgacgcaacagttgtgttgggtcactaactagcgaaaacctacattaggagtgaggggtatattatgaattcatttatcgaatggcttaacaaacacttagtgccagttgcggccaagattggtgcagttcggtggttgatcgcattacgtgacgcgtttatagcaattatgccggcaatgatggccgggtcgatcgccacggttctgaacgctttagttcgagatattccaacgaagttcggttggatgggcattgttaattcgatgcagtggttgattggaattaatgcgatggtttggacggggacgttagccatcttaggtctgattttctcatttacattcgggtatcaattggcaatccagtacaaagttgaaccagttactggtgggatcgtgacacttggaactttcatcatgagtttgccacaaaactttaccggcacgttgacgagtacgttgagcaagggcgctactaagattttgacggactctggcatggcggttgctggcaaaaaggtgacggcttggggttacttcaacttcaacacgtactttggttcgtatggtttctttacggtcatgattttaggggccattgcgagtgccgtttacattgctttgatgaagaaacacattacaatcaagatgccagattctgtgccaccggcagttgcaaacgccttcactggggttatcccagccgccgctgcattttatgtcgttgggattattaactggatcttcagtaaattcaacaccacggtgattgaatggatcgcgaagattattcaagaaccactattgaatatgagtcaagggtacggcgccgtcctcttaatgacgctgttagttcaagttttctggttcttcgggattcatggttccaatgtcctggcaccaatcttggacggaatctggttgacggctcagcttgctaatgttaacgcttaccaagctggcaaagccttgccatacgtttggacgcggaactgttttgacttatatgcatggattggtggggccggctcgaccttactattattagtagcgattttagtatttagtaaacgagacgaccaacgttcagtggctaagttggcgattggccccggattctttaatattaacgaacccgtgatgttcgggatgccaattgtacttgacccaatctactttattccgttcgttttagcaccagttgtgactgtttcgatcgcctacgctgctttatcagctgggtgggtcgcaccgattacgaacaatatcgtttggtcaatgccaccgattatgaacgccttagttgccacaatggactggcggtcagtggtcttacaattatttaatgccgccgttgcctttgcgatttacgtgccattcgttaaggctgccaacaagattaaaccagcagcgattggagaatagattgtcatgaaaagcttaaagcagtgtttactcatcgggatgaaccttggattattagccgttatcttaagtcccctggccggaacgaccggtcaatgggtgacgctcggattaggtttagcggtcagcgcagcacttttcgtcgtttatcggcgagtgggtcagatagaaaggagccaccagaatgcagattaaattaactttgaacgcccctgtggattatttataccaacagttgatcgattccgcgcgggctgatattcagcagcaaacgggtcggccggcgccacggcagagcttacaaggctatgagtatgccaaacagtggtccaacggtctgaccggtaatttgaagattacccacgcgcaacccggtgttcgatatgcgtatgaattagaaacgccccgcgatcattacggcgtcgattatcaattcgcaccggacactgatggtcaccaaactgtcttagaatatgccgaaacctttttaggcaaggataagaagacgaatgccaataataagcttggcgtgctattcttaggatggttccgtaaacgccgctttaagaagatgatgaatcagatggctgctagttataatcaataagcaggctggattcaaaaattgatttcgttagaagagtgctgtaaatccgtaagtggatttacagtacttttttgaacagatatggtacacagcgtttcagatgtggtcgtgataccatcacgatggaacaagtgagcaactgcattgtaagcgcttttaaaacgcatgtagttcacttatactagcttttgtaagttaaatcaaagggaggaacaacttatgatgaacggttttaacgtgtttatggaaaaacacattgtaccatttgcagtcaagttgaatgaacagcgacatgtcgcggcaatccgtgatgcttttatgtacacattcccaattacaatggctgcatcgttagttattttaattaataacttagttttttcaaaaacggggtttattgcacaaatcttatttttacccaaattttttccacacttggaaaatgcccaaaagttattaacctcagtaactaacggaacgatgaatattttatcgatttttattgcgtatctggtggcacggaatttggccaaatattttaaagctgatgacatgttagtagggatgacggggattgcctgcttcatgattttatactcaccatcaattatcaaagacggtgtaacctatttgccaacgacttatttaggtgcacaagggctgtttgttgcaatgatagtaggtggcttagttggagaatttttaccacggctaacgcgcattaagaaaatgcaaatcaaaatgcctgagatggttccgccggcagttgcacggtctttcaatggcttaattcctatcgttattatgattatgctgttttctatgttgaactatgggttatcactaatttcaccacaaggaatcaatgatattatttataaatcaattcaaacaccattaacccacattggggtcaacttatttggcgttatcattattgctattgttcaaaatcttttgtggcttgtcggtatccatggtccaaacacgttgaacgcgttacgatcaattatttttactgaagctgatttgaaaaaccaaacgtttattaacgctcatggtacagcttggggtgtgcccaaccgtgcaacctggagtgtgttgaatgatgtcttcgccaatatgggtggtagtgggatgacacttggcttgattattgctatcttcctcgtctcaaggcgtaaagattatcgtgagattgctaaattggcattagtgcccggcctcttcaatattaacgaaccgctaatgttcggtttaccaattgttttgaatccaattatggcgattccattcgttctaacaccagtgatcaatatcttggttggctatacagtgacagttatttttaactggataccgacgccggcttttggattgacatggacaacaccgggaccactgatgccgttcttggggactggtggcaattggcttggcctgattattggatttgtttgtttgggaatttccgtgttgacgtacatgccatttgtactcgctgccaataagatgatggctgcagatagtcaatctaaacaagatacggatacgacgacagaaacggttaaagcatagtttaaaaggagtttaacatgacgattaaaggacgagcgtttccagaagggttcttatggggtggcgcagtggctgcacatcaactcgaaggtggttataaagagggcggcaagggtctcagtacggcagatattatgacattagggacgaatgagcgccctcgtgaaattacggacggagtagtggctggcaagtattatcctaatcatcaggcaattgatttttatcatcgttatcccgaagatattgaattgtttgctgaaatggggtttaagtgttttcgaacatcgattgcctggacgcggatcttccccaatggtgatgaaagcgaaccgaatgaagctggattacaattttatgatgatttatttgatgaatgccttaaaaatgggattcaaccagtagtgacactagcacactttgaaatgccatatcacttagttaagcaatacggtgggtggcgtaatcgtaagcttattcaattctatttaaactttgcaaaagtatgttttgaacgttatcgagataaagtaacgtactggatgacttttaatgaaatcaacaatcaaactaattttgaatcagacggtgccatgttaacagattctggaatcattcatcaaccaggagaaaaccgtgaacgctggatgtatcaggcggctcactatgaactggtggcgagtgccgcggcggtacagttaggccatcagattaatccagattttcaaatcggttgtatgattgcgatgtgtccgatctatccgcttacagcagcaccagcagacgtcttatttgcgcaacgagcgatgcaaacccgattttattttgccgatgttcattgcaatggcacttacccacaatggttgcgtaatcgttttgagtcggagcattttaacttggacattacggcagaagatttgaaaatcttgcaagctggaacggtagattatattggatttagctattacatgtcgtttactgtgaaggacacaggaaagctagcttataatgaagaacatgatttagttaaaaatccatatgttaaggctagtgattggggctggcaagttgatcccgttgggttacgctatgctatgaattggttcacggatcgttaccatttgccactgtttatcgtggaaaacggtttaggcgcaattgataagaagacggcagataaccagatacatgacgattatcggattgactatttaacggatcatttacgacaaattaagctggcagttctggaagatggggttgatttaattgggtatacgccatgggggtgcattgatttagttgcggctagtactggtcaaatgtccaaacgctatgggtttatctatgttgatgagaacgatgatggttcaggtagtctaaaacgttataaaaaggattcatttacttggtttcaacatgtgattgcgacaaatggtgccgaaattgagtagtgcgatttgggtatgacgatggtcattaattattgactagtgcttaattaatgatgtttgaaatagttgtcaatggccagctttgatagctggccattgggcgtttaggaggactgttaaatgacaatgtatattggaattgatattggtggtacttcaatcaagtgcggcctagttgatgctcatggacatattagtcgtaaagtaacacgaccgactgccacagcaaaggtagacattatggccgatttagttgcgatgattcaaggactacaagcagatggacaagttgctggtattggagttagcatgccgggagttgttcaaagtgacggcttcttgacgacggcaggtgcggtcacggcgtttgaaaaaattaacttgcaagctgagttacatgcacagacgcagttaccggtcattattgaaaatgatgccaacgcagcggctattgctgagcaatggctgggagtagctcagaatgtgcctaattatttaagcttggttcttggaaccggggtcggtggggcactggttatcaataatcagatttatcggggtgcacacgcgcgttcaggcgaatttggttggatggttgttgacgatgatgagattgatactgaaatgggaacccttaatttccggggtgcaacagttatcggtctcatacgacgttataatcagtttagtgcgatgccggttactgacgcgcgcgagatttttgaccgagcagatgcgggagaagtgctggcacaacatgtctttcatagctactattacagtttggctaaaggaatcattaatttaatggttgcttttgatcccgaattagtcgtaattggtggtggcattagtgcgaacacgacctttatgactgatttgaatgcaacgattgcagacttacaggctaatcataatagtattaatcatttgactttggcatcagtagtaccagctaaattgcggaatgatgctgggatgattggggcagtgtatcagttgattaagcgtggttaaaaaggcggatcaaactggtttattaaaatagggtgacacgtattttaatttaaaaaatgaaaaagcttgaatgctagatgttttttagaagcggttacgcatttatggtaatctagtgaatagattattagatagggtggtggctaaccgtggcattctttggctataaggatatcgataagttatctggagtagatttagcaatttatcgatttattgtggagcatgatgagcaaatcccgtatatgcgagtccgtgagttagcgcggggtgcgcacgtttctaattcgtcagtcatgcgctttattcgtaaaattgggtatgatagttttccagaatttaaagtatcgctacgcagtgaaacgcccattcaaaagccggatgctccaggtattcagtttgttcaaccgagtgcctttcctgcagatattactaagattattcgactggcagctcagttgatggtcaatgcggataatatcgtgtttgttggtatcggagcatcagcggcgttgggcgagtatgcttcacgtcaaacgtcatcattaggatttaatagttatgtcgtcaaggatcctttctatccactattaccacaattacgtaatactagtaataacgttttggtggcagtgtcagtctccggtcagacgtctgagttggttgaaatgcttaatgactttgtgaataatcctgaagtcaatattattagtattacgagtaatcttgagagtacgattgctcgaatgagtcgatatgcgttaacgtatcgggcgactgaggagcgtattcatcaatattatgacttaactagtcaagtgccatgcctttacattattgaggcactgttacgggaacttcgtcatcaagaagtcgtccaacaccggtttgagtaaacttttaatttatttagccagcaaacgtcattcctgcaaagcaggcatatcaatgctaaaattaaaagcattcaatccaaaagttaaactagtgataagggagtatgagaacgtgacagcaacaccattctggtcgcaaattgcggcccaagccaaggcagacgggcgaccattttttacgatggccccgatggaagccgttagtaatactgtttttcggcaagtcattagccatgccgctgctccagatacgttttttagtgaattcgtctatgctaagagtattacgaacccgaatacgaagtttccggtgcatggtcgtttgtacgtggcggcagctgagtcgcaaaaaccggtcgttcaactgtggggtaacgaagcggctgactttgcttcggctacagctgaacttcgtgaccggggctttaaagcagttgatatcaatatgggctgcccggatgggacggtcatcaaaaatcatggtggcagcgatttgattcgcaatccgcagtgggctgaagacgtgattgcggctgcaaagacgtcgggactggccgttagtgcgaagacgcgcttaggttacagtaaagttgctgaatatcatgactggattgcaacgttgttatcgcaacatgtggcagtcttgaccgttcacttgcggaccaaacaggaaatgagtaaggtacccgcacactttgaagttatcgatgacttgattaaaatgcgtgatgcgatcgccccggaaacgttactccagattaatggtgacgtggctgattatcaggccggggtggcgttagccaaagcacatcctggattagatggtatcatgattggtcggggagtgttcgcgaatccgtttgcgtttgagtcccagccccaatcgcatgatttgcatgaactattgggtttactgaacatgcagctcgacttgttcgatgactttgccacccgttatgacgtgccacgttttccgtccttaaaacggttctttaaaatctatgcgcgcccagaactaggcgctactgacctgcgtaacacgatgatggatgccaagtcaacggatgatgtacgcaaaattttagcggcttatcaagccaaaatgcgggtgaccaatcacagttagtgtcagcagcagacaggttgattaaggcagtaatacgttaataaacttcaatcttattatatagaaacatctcgatatcggcagtgagtgctaatgttgggatgtttttgtatctaaaggggtatgacaattgtattcaaatttaggcccttgttaggagttggtccaacagctgttcaattcgacgtttttttagaaaaaaacttagtcacttttaagtggaacaggcgtcaattgacgtaaataatgactgatggcaatgactagcggagtaattacggacgattgccgtgtctatctgattaatgaggaggtgctcaataacaagtttcggtcacgtgatagtgttaatttttgcttgtagctcagctaattaggatgattgtaacatcatttaaaacgattgtaacattactgcgttacaatcgaagaaaacatgttacaatcatttgaatggagggggcgaagaatgtgataaagcttgttaaccaactagaacatattagtcaaagtacgggtatcccggtaactattggcgaatcggtttcaacgtcgacattgtcgttgagtcgttcggatcaaaataatacggtggttgtgcaggggacaatccttgataagccggtcctttttatgtcttatggtggtcagcgcgatttgcggccactagggctctatgcacgagttagtcaggtaaatcgagacccattggtgtttatttttcctcagctttccgccaatgagcgtcacgaatatttgaaaaacagaatgccatttatgacatcagatggtgaaatgtttttgccgtttatggggacacggttattacctgaagccgtgaatgactcacctggaatagcgggcaatcctttagcctccgcggcacaacgactagcattaaccatcgtattagcacagttgatttttgaacgtcatccagagaaggccaaagtatgtcccgagttagcagccttcagaacgactgatgaccgtttcttgatcaaaagcggacaatgctttgcatcaacgattggcaagcaagttagcatcaataatcgagttacctttagtcgagcggttaaaccgttagttgcacatggttggctgaagtcaatcggcgagactaaggagcgcgtctatacttgcgagttagatagccgccgtttttttgatcagatagcgccattcttagtgtcgccagttcaatctgttgacttggtgcagttggcgaaaacatcagttgaatcagctagtaagaattttctttattccggccttactggtttatctaaagtgacgatgatcagtgataatcggaagcaacagacagttattatggaccgttctcgacggcaaaccttgaggacaacggttgacgcagataccgatgagcggaaagtcgcttgtgaggtgcaagtttcaaagtatcagctcagcggttttaacacattgtttagactaattgccaattatcctaagaatgtgttggatccctttcatttatacgtactatttagaaatgatatggacgagcggactcaaggcgaagccgaagaattggttgatcaaatttggaacggagcataaggtgatgctatttcacaagttctttgactttttcgaaggctatgaagattgttacgttattattggtggcaatgctgccgcaatttggttagcgcaagatcatcaggattttagagcgacccaggattacgatatggtcgtcatatttgaaaatagtcaactgggcttttcacaaaagtttgatgactttatcgagaaatatggctacttgtgtgctgagatagggggtgatgtgaataagaagaaagtgtattaccggtttgcgttagatcctgcacttgcggtcacgggcgtcccccaacagattgaattgttttcaaagataccattgcgctatgaacttagattaccgacagagacaatgccgttacattttgcaacgggccctagtttgtcggcgattgtattaaatgatgattactatagcttgttgaagcaatgccagcaaaagattggccatgtttctatcttaagcgtacccggattgatctactttaaagccaaagctcatcttgatattcggcaacggttagcaaatggtgataaattacgtcatcgtgctaataagaacaaacattataaggatgtctgccggttgtgtgatttgattattgagaatcaaacgttcgactcaaaggtcgtaccaaggacttgtcagaatgatttaaaaagttttattcagctggttgaagcagagcccgagcaaatattcaaaaaacgatttaaatcagatcccgattttgacttaaaccgggacgaagttgttcgagttctccgatcgttactgccaactagctagtctaatgaacccaaaatgaacggccctagtcaaaacactagcgtcgttcattttgggctttttgatattttttggtgtgcaatccggccctagaagtcacagtgttacatcataaatgttagaataaacctaactaatattttataaacgaaaagtgagcgtggtgttatgagaaacttagcgattgtggatttagggtccaattcggcgcggatggcggtcagtcggttgcatgctaacggcactgctcaagaaatcaagcgtgttaaggaagatacgcgtttgtcggaaggaatgggaacggcacacgtactccagcccgccgcaattgagcgaacaatcaaggcgttactcaattttcgccgactttatgaaaaaatgcccaatacggatgttattggcatcaccacagctgcagttcggatggcacaaaatcaggctgaatttctcaatcaagtcaagcaagaagtggggctcgatttacgagtcttatctggtgacgatgaggcctattacgattatcttggggttgccaattcattggtcatccatgattgcctaatcttagacacgggtggcgcaagttgtgaactgatcttggtcaaaaatggccgcaaacagcaactgatcagcattccatttggcgcggtgacattatcggaacaattcggtctcgacgacttagtgccgtctgcgagtctatttcgggcgcagatgttcctacgtaaccgactggcagatatttggtggttatcagaagcagtgcacttcccaatcattctattgggtggtgccaaccgaaccttagcccgcattaatcggcgccggcaacaaaagttaaaagttgaagatattcacgggtatcgtctgaagacagagacggtgttccacacgtttttggacttactgtcacggtcgaaaaaaggtcgccaggaaatttcaggaatggaatatgatcgtgcggacattattgttggtggaatgttaccgctagtgacgttattacagatgttggatagtgatcgggtgatcttttctgaaagtggtgttcgtgagggaattatttcagaacacctcaatcaataggtcggttcggtagatgagtcgaatggagagaataggaatgagaatatgacagctgattttcggcacttttatcaaaaaaattgggcggaacgcactgccatcgtggcgcaacaggcccatttaacgccagctgaacaggcgttatttaaacaatattatttaccacaacatcatgaaattattgagaattatttgacggattacccattaccgatggggttggctgtcaacttagtcgtcgatggcgtggatcacattgttccaatggttactgaggaaccttctgttattgcggcagcaagtaatggcgctaaaattgtcaagcgtgcagggggcttcacgaccgtccttaatcaacgtgaaatgattggtcaaatcgttctggagcagttgtctgatccggctgcaaccgctgccgtgattgaagcccacgctgcagcattattaaaagtagctgatgcggcccatcccagtttaaaaaaacgaggtggtggcgctcggcgcctacgtacgcgtgttctcggacaaggctatttatcaattgacctattcgttgatgtgcaggctgctatgggggccaatatgctcaatagtatgttggaagccgtggcaaagtccatcggtgtgatgacgaagcaggacgctttaatgagtattctatcgaattatgcaacggcgagcttagtcaaggccatttgtgacattccggtcggattattacaggctgggcggtatgccggcaaactagttgcccagaagattgcgtcggccagtacggtcgctcagcttgatccgtaccgggccacgactcataataaaggtatcatgaacggtattgatgctgtcgctattgctagtggcaacgactggcgcgctttggagagtggggcacacgcctatgctgttaaggacggtcaatatcgtggcatgagtacctggaccagtgatggtcggatgctgcatggtgaactggaattgccactaccggttggcattgtgggcggttcaatcaaaattaacgagttagcccagttgaatcaacgaatattaggtattcaaacagcgggtgatttggaaagaattatggttgccatcgggttagcccaaaatctagccgctttacgcgccttggtcacgactggtatccagcagggccatatgcacctacagttgaaatcgctcgcgatggcagcgggagcgactcctgaggaactccccgttatcttacaacgacttgaattagcatctcaacaagacctcgcaaccacgcaacaactcattgcggaattgcggcaaacaaaggaagagactgatgactgaaattaaattgaaccaaactgttacagatttattaagtaccgccaattcgttatatccgggcaatattagtgttcgttttggtgacacaaaagcgggttacgtccgccatgatcaagcacaacaagtgttagatgatggtgacctgaccgttcgggttagcgatattacggctcctaattacacagcgtcacatgaattattacatctattattgttattacaaggctttccacagattacctttaatttaaccacgcgtgatcaacaactggacgaacaattgatggcaatcgctatggaactttatgacatggtgagccacgtcttggtcgtacgcaaacaacgggaacataacttaatcgatgagcaaattgaaacgctatacatgcaaggtgtggcggccacaatcgaaccggaacctgcgggcaaggcggatgcgatgatgacgttacggttattaacattgactgacctactcgttttctttaatggtgaattaccagctgatgatttgcaaaaggtgacaacggcctatccacaagcttggccggctgcacagaagctatacgccgtaatcagtcagaagccagttgacaccccgttcgcgatgcggcgtgccgtagtaaagctgttcaaggcttttgatgatcagatgacggcttggcatttaccagtcctacacggaacggaatttgtgaccgttcagagtgtgctcagtgaacggcaagagcggctggaagtccggcagttatttgacgtttaccattcagatctattagataaaaataaacatacccgagcgtacattgggttatataagagtgaccgtcagaatgcgtttgtcctaccagcaccggcgcaaaagaagagcgatgcctttttcaaagaggtgtacgataagacggtcaaagaattattccaagaaatgaatctaccctatacgttacggtaagctaagcagggagatgtcagaatgagtgacattacagcagcacaaacaactttacaacaagctcagcatatcgtttttatgacgggggccggcgtttcgacgccctcgggaattcctgattaccggtctaaaaatggactgtataccgaacaccataacgcggagtattatttaagccacgcgtttttggcggagcatccgctggaattttatcaatatttacaatcaaatttatattatccagacgcccaaccgaatgtgattcatcaaaagatggcggcactgactcggcaagggcgggccagtgtgattacacaaaatattgataatttatatggggtggctaaaacggctcagctcgttgaatttcacggtaatctctatcaggtctactgcaccaagtgtggtcagcatgtcgattggcatgagtatttgaagtctccttaccatcagacagaccatggctacttacggcctaacgtggtgttgtacgacgaggggattgcgagtgccaatatcgaacgggcagttcaatatttacagcaggctgacctagtcgttatttgtgggacctcgtttcgggtgtacccgttcgccggcctaattgactatcgtaatccgaaggctcaagtgcttgcaatcaatgcggaaccgctccagttgccatttgcatttacgatggtgcaacaagatgcggtcgacttcttcgagggggtgcaggtctgatgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgatacttatgacgaaggggtctcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaaaatgatttatgagtgattgatgtgatactttgcttaattgaacgagttatcagttgaattactatgttggctcaatacagtcactatgaccgtgaaccgttgaaatttggtcgtacggttgaatattctttaattgatgaatcatgacaactaaaaatgtagcggtagttcggacattcaataatgtgagctgccgctacatttttttgcacttacaccttagttaatcaatatggccttagccatctgatttgaaagcgaacggttgggatacatcatttggaagtaaagttagtgtaaagtcaagaagtagtttatgtaaattcctgtttagttttggtaataattatctcgttggtcgtggatacgatggcttgggactgccttaaaactaggcagttataagtaccttaattcatgattcttaggtgaattagggtgattgagaaaagtgcgtgattaagatacactgacttcagttcaagcaactaagtagttgcctgccactatgtgagttgcagatagttatggcaggttgaagtgttgttgagaatcgaatgttaggtcataacaatatagattggggcggattgggtatgcaaccggatattatttgcgcaaatggggttttctgcgctgatggaaaagtcttattaacacgggaatcaaaaaacacagcctattattttcctggtggcaaggttggtgtgggagagacgctaacacagactctgcagcgagaattaaaagaagagttgtcattagttgtgtcgccagatcggtttaagtgggccttcacccaccgtggtgtggcctataatcaaccgggaaaaatagtcgagttaaattgttttttagttgcggggagtggcgcgctcaaagtcgactcggaagtttatgattataagtggtgtcggccggacgatagccggatcgcggaagtcgttcgtgaagcgctggcccgatattcgtgggttgttgaataataatagattaccaataaatgaccggttaaaatcaactcgtgattttaatcggttattttgtggtggttggttgggccatttgaagcatggtgcacagttgactagtctgccacgatctttgcgtgtggagaactcttttgttagtgtttcttaataaacacaggaaatatgatacaatataagagattctacacattggcccagcaacatgttattttagaccaagacgtgttgtttggacgcgtgtgatttgttcatggattttaatcaaagacatgcttaacgagttaatcataaaccagtttgaagggaatttacgtcatggcagaaacaaaaccaacttattatattacgacgccgatctactatccttcggggaagttgcacatcggtaattcatacacgacaattgcgtgcgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatgacaagtttattcggaccaccgatgattatcatgaacgcgcagtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagctaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactccgaagacttgtttaacaagttctggcctgccgatgttcaaatggttggtaaagaaatcgtgcgcttccatacgatttactggccaattattttgcatgcactcgggttaccattacctaagaaggtctttggtcatggttggttattgatgaaggacggcaaaatgtccaagtctaagggtaacgtgatttatcctgaaacattggttgaacgttacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattaccagcattcaaagccggtgtgactgaatttgacgctgacttagaagccacagctgccacgactattaagaacttcaacgcttgcatggacagcctgcatttatcggatgcgctggctgaagtgtggaagttggtcagtcggacgaacaagtatattgatgaaacggcaccttggcaattagctaagagtgacgatgcgaatgatgctgataagttagccagtgtgatggcccatttagcagctagtttgcgggtgattgctagtttgatcagtccggtcatgacgcatgcacctaaggaaatctttacccaattagggttggacccagcaactttagcaattgccgacttacaactggctgatttgccggctggcgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcaattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaaccggaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggatcattgatttcgtaaaaactaaatgttgaataaaaaatcgggcgcactgactagtgagctcgatttttgatttgtaattcaattgttattttagttgtttttgacaaatgggttaatctcccgtacagtagtacgaacaagaaatgaggtgagaacatatgaaatatgaacagattctcgtatgcgtctccgtagatggaaaaggacgtttttccgaaaattaattaaatttaggagacttaattaaatgaaaaacgtccaaaaacaagtgccatcattattactgttaatcacattagtgggttttccacaaatcagtgaatcaatttttacgccgatcttgccagcgctcagtcaggcaatgcacgttagcgccagccacagccagctaaccatgagcagttattttgtggcttttgcagttggggtgctcttctgggggcaatatgctgactatcgcgggcgccgtgatgccatgttaggtggattagccttttatttgattggtaacttagggttatatctgagcccgggctttacttggttattggtttgccgcttgatccaagctttcggtgctagtgctggttcggttgtgacacagactatcatgcgtgagagctttacgggtgttactggtgcaaaaatctttgcgaagttgagtgcggccatggcactatcacccgctctcgggccactcatcggaggtggcgtccagactgtgttcggctatcagcatgtcttctcggtcttgatcatgatagcagtcgtaatactgttgtacgcggggtgttgcttgccagagactcgaccagaaacggtcaaagtggcctcttggcggcaacaaagcgttgtcgtttcacggttattgcacgatcccgtggtctggtgttacggcctattgattagtggtattaatggtattttgtttagttattacgctgaagcgccgtttatttttgaaacgcacttcggctttagtgctgtgcaatacggtagtctcggtttagtcttagccgcggccagtctgctgggcgcgttgctagtgaattggcttgtcaactattggtcaccaatgcaggtcgctttaagtggcttaggattgagtttggtagcggcagttggcttggtgatgaccgctgttggcaatcacgtcattgggatgctgattgggatttttctagccttcttaggtctgaacatcaccctaccaaacgcgttgaatcgtgctttgattggctatgaaacggtgatggggagtgctagtggctggtttagcctgggttattatctgctagtgagtgtgctaacttacttaatgagtttgctccaccacggcagtgtcgtgacattgcccgtatacatgttaggcgtagtcacggtgatgacggtggtgtacgcggggctgtattggcagcgtgtacgtcattgattttgcttgaaagcctgggggaacccgggctttttattttagaattaccgtcttcttttccgaaaacttgcgtcccatggtaaaatcaactaagataacaaaagtcgaaaaggggttattacatgcggatttttgattctcatacccatttaaatagtgaagaattcatccaggaagtgccacgttacttacaacaagcggctgaccttgatgttacgcggatggcaatcgttggttcgaatacacaactgaacgccgatgcgattaaactggcggaaacgtatcctcagttggtcgcgattgttggttggcacccggaagatgccaaaaactatgatcaggcggctgaaaagttgttgattgaacaagtccaacatccgaaagtcgtcgcgttaggtgagattggactggactaccattgggatacgtcgccacaagacgttcagcggcaagtctttgcccgccaagtcgccattgctaaagagatgcaattgccaatttccgtgcacaatcgtgatgctttcgaagatacctataagatcttgaaagcagctgatattcgtgacacgggtggcgtcatgcatagctttaatggtgaccctgagtggctcaaacggttcttggacttaggcatgcatatttcctatagtggtgtcgcatcatttaagaatgcgcgtgaagtccatgaatccgtcaagcaaacgccactaacgcaaatgctggttgaaacggatgccccttatctaacgccggaaccataccggggaaagcagaacgaacccggttacacgcggtacgttgttgaagcaattgcccagttacgtgaaacgacgccggaaattatagcggcccaaacttatcaaaatgcagaggaattttttaagattgaaaaagattaaagaagtaattgtggttgaagggaaagatgacacgaagcgtctcgccctagctgtcgatgcagatacacttgaaacgaatggctcggcgatttccgaagccaccttagcccagatcaaaacgttgcaggccagtcgcggcgtgatcgtgttcaccgacccagacttttccggtgaacgtattcggaagacgatttcggcggctgttccgggtgtcaagcacgcctttttgccccgcaaagctggtgtaccaactaaggctggggggagcctgggcgttgaacacgcgagcccagcggcgatccaaactgcactcgcccatctatatacggagcaaatcgacgagccccaacagttgatcagtcaccatgatttgattgcggcgggcttactagctggtcccacggcgcgtcaacgacgcgaacagttgggtgaacgtttaggtatcggatacgtcaacggtaaacagctgcccaaacggttacaactatttcaaattcagccagctgatttttgggcggctgttgaccaactaaccacagaggagaaatgatgagtagagatttagatattgcgaatcccgcccgcacacgggcaattatgcatacgtacgggttacaagttaagaagagtttaggacagaattttttaactgatcagaacgtgttacacaacattgttgccactgctgacattggaaccaatgataacgtgattgaaattggccctgggatcggggcactgactgagtatttggcacgggctgcgcaccacgtcctggcctttgaaatcgatgatcggttactgccaattttggatgagacactagctgattatgacaatgtaacggtcgttaaccaagatattttgaaggccgacttagccgcgatgatcagtgaacatttagataacgagcggccgttgaagctcgtcgccaatttaccgtattatattacaacgcctattctgatgaacattttggcgggggacgttgcttttgaaaatattgttgtgatgatgcaaaaggaagttgccgaccgtttggcagctgaaccgggtacgaaggcgtacggtgcgttaacgattgctgtgcaggaccggatggctgctgagatggcgatggtcgttccccggacggttttcgtgccgtcaccgaatgtcgattctgcaatcgtgaaattgacggcattgccaccgcggacacacgtgccatttgacgaagcagcttttttcaaggtcgttaaagcgggctttgcgcaccgccggaaaaatctgtggaataatttgcaaagcctatttggtaaacaacctgagacgaagacggccattcaacaggctcttgatatcgcgacgattgatcccaagattcgtgccgaacggttgacggtcgatgaatttattacattgacggatgcgttacatcaggctgacttactttaagttatctatgcttataaaatggttgcacattagaaaaccttgtgatataatattgacttttttgtgaaaagctagtatagtgtctttcatgaggaggattctcaatgccaatttcactagctgcaattaaagataaacttgactcacggatcggccaacgcatgaaggtcgttgcccaggctggccgtaagaaaacaactgaacgccacggtatcttgaaagaaacttatcgttcggtgttcgttgtggatttagatcaacaagaaaacgcatttgaacgggtctcctacagttatactgatgttctgacaaagaacgttcaaatcgcttttgatgatgaaacaactgaagcttaattcgcgtctcgtgaattctcaatattaagacccccaagcaaggtctttttattttgccttgatattagtataattgtatcaaagtaagtcagcgaccccgggtaatcgcggtcatggaagagggtgagacgcgtgcagatcgttgaaaaagcaccggccaaaatcaatttaggactggataccttatttgaacatccaagtggggataaagagtgggacatggtgatgacgtcggtcgatctggccgactatgtcatgttagaatcattgcatacgaaccgaatcgaagtggtcaccgatagtggctttttgccgaatgatcgccgtaacttagcttttcaagcggtgagcgttttaaaacggtattgtcatgttgatcggggtgtccgtatcaaaataagaaaggccattccggtagcggctggtctaggaggcggctcatctgatgccgccgctgttttacggggcttgaaccggatgtggaatctccacttggacttagccacgttagcacgtttgggattgcaagtagattcagatgtgccatactgtgtctacagtcagacggcccacgtgacgggaaaaggcgatgtagtcaccccgctacctaagttgccgccgatgtggattattctagcgaagccgaaagtcagtgtgtcaacgccaaatattttgcggcaggtcaattacgagcgcatcgaccagcatcccaatattgaggccttgttggctggtattcaacagcaggatttcgcggagatttttgcgaatatgggcaacgttttagagccaatcacggcaaaacgctaccccgagattttacagatcaagcggcaattgttaacgtttggggcggatgcggcccagatgagcggcaccggaccaactgtgttcggtgtgtgtcgcaaacaatcgcgggcgcaacgcgtgtataattccttgaagggtttttgtcgggaagtataccttgtgcggccggttaatttaaatgaacattagaccgcagtagtccgccgtgatggtgggctttttttattggtacgggcttaggtgagccgagtctctaatttactgctacgcttaaacggtagcgctgagccatttgtcatcacgacctgtgtccagccagagatggtgtagcagtgcaattggcaccggaatgcgagtagccgcggctttgcttgcaggttgacacccgaagatggtcgttgccttcaacgcatcataggttattcggacaacgcaatctctttttgtaagcaatttatgcgcgtttatgattaaataaggagtaacggaggtgttcggatgaagcagtcgacaaaatttggattgaaattggcgggcgtcattggtgctgcaacttatgcgggaacgttacttggtggcttagcggcgtatcaagtcgcgatgcacgtgagtgacgcacagaagcagcagggccgcgaacgttcgcgggcagaaaacactgaaattgagaatttttggtatttcaagcagcctaaacagcagtggatgatccagtcctttgatgggctgaacttagtggcaacatatatccctaatccgaaaacaattggccgcttggcgattttggcgcatggtctaggacattcgcgcgaacaaatgattccgtatgcgcgcatctttatgagcttggggtatgacgttttaatgcctgatgcccggtcatttggtgatagtcaaggccatacgattggttatggttggctagaccgactagattatgaacgttggattacgatggcgcttagtcaattaggtctggatattgacatcgtattgatgggaatttcgatgggggccgccacggtcatggcgactagtggtgagccgttaccggagaatgttaaagctattgtggaggatagcggttatgcggatctttatgatgaagcgaagttcagactgactcataagttccacttgccagcctatccgattatgccggtggcgaatcgcttagcacacgttcgcgcgggctatgggtttaaggatggccggattctgcaacgggtgattgatggcgggttaccgatcttgatgattcatggttccaaggatcagacagtgcctgttcgcaatgcacataccttgtacgaccagttgccacaacaaaagggcctgtatatcgaccccgatgctggtcacgttgaagccatccgaacgcacccggatcgctatcaagaagtgttggatgaattcttacatgagcaggcggggttggcttaagcccccttaaattaaagtaatgataaacatgaattgaccgtgttttaccggcttaacggtaaaaacggtcttttttttgcaatctcgtcttagtgacaagcgcattcaactagtggtcaaggtgttatttgattaggcccccgatgattgccatggctggtaatgattgcggcattttgagctcaggtattgacaaatcaccgcattcaggtaaactaaaatagtaatcattacgatttactttaatttagaaagttggggtagtgttatgacggaaccgttaattgccgtccaacaccttggaattggctttccaaacaaccaggtgtttaaagatttgaattttaacattgaacaaggtgactttttgaccgtgattggtgaaaatggggtggggaagaccactttaattcgcgccttgcttggcatgctgaagccaacagccggtcaaattaagtattatccgaataaaaaagccattaaaattggctatgtgccccaatttcgcaacttagaccaggagtatccgttaacgattgaggactttgtcgggctgaacctaaaagggtggcagccgtggctgtctcgagctgaacatcgtcaggtagcgacagcattagccgtgaccaatttgaagaaactccgtcagcgaccgcttgggatggcttctggtggtgaaaagcagcgggcttacttagcacaagcaattgtgcaacaaccgcagctattaattttagacgaatcgacggctagtctagacaatgaaatgaagtatgaattgttggacctcgttcagaacttaaaccaaactagcaacattaccgtcttctttgtgacgcacgacttgccattagcgaagcaatacgccaaacattatctggccttaaagcccggccaccagcaatttggcaatatcgctgatatgtcggtagagcaattaaaggaggccactaatgtcaatgtttagcttagtatttatgcgaaacgcctacttagcaggaacctttattgcaattatttgtgggacgattggcgttttcgtgattgcccggaacctctcatttctgacacacacactgtctgaaattgggtttgccggtgcagccttcgggatttttatgggctggaccgcgttgagtgggatgctgatttttaccgtgattagttcggtcatcgtggggcagatgagtgtgaaacaatcacgacgcgaagcctcgatttctgcaatttccgctctgtttatcggcttaggaattctattcctgtcgttatctaatcaaacttcgagttatgcgacgagcatcctgtttgggagtgtgattgggattgccagtgcggatgtcatccgggtcgcaatcttatcggccatcgtcctactcgtgatgttgggcttgtaccggccactcaaatttgattccttcgatgcgattggcgcccgggtgagcggcttatggacgaccggcatctcagtggtcttcttggtactcgttgcgatgagcgtcagcgtggctgcccaaattgtggggtcattactgatttttatcttactcacgttaccagcagcggcagcgcgatactttgtccatacggttagcaagatgatttttctagcgattggtttcgcgttgattggggtttggctggggctgtacttgagttacgtcacgaatttaccagtcagtttcttcatcgctgcaatcgagtgtatcttctactttgccgcgctgggttatcagcgacttcgggtcggaagctagtggagctattcttgttcagctgtatcacgttaaaagtaggtagtttacagaattaagtggttcgttgtgacacgctaaaatgttactagtcgtttctggaattcattgggaattctagagcggctagttttttgttcgtgttggggttgcaacttttcgtttgcgtggggggcaagtcacacaagaagtcttctaaaagcataagtccaagggtagcgctgtaattgccacacttagtcgtaggacgggaatcagtaaaggtatcatttcgtttttgacggatatgattgggtataatgatatttataccattattacggggaaagatgtgctactggtaagaagcgttctcgtttgaagggtgcgttttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaagcccaaaaagacttctcatgcgacaaaacacaagaccaagaagcacaacagaagcgctacaataagaaaaaagctgcgggcaaggcaagaaaagcttctcagagaaaacaatcctcgcagaataaagatagtcatgggaaaaaggagaaatctagcaaggagaaatcttcaaaagatgggaaagataaaaagacaaataatgtcccattggaaaatggctcttatattaggaacggaaaaccttatggacgaccaacattaaccgggaagaaaaaactcgaattcgagcgggaagtatataataggcaagctaaagatggagtgcttattgatcgaaatacgaaacaagtgatacattggaagccgggttaaccccgaaaaggaaaggtcgatttcggacatctaccgggtaagtcttataaggaaatgttcaatctatataaaaataggaagatgacattgaaggattttcaatttaatcccaaaaactctagattagaaactccgtctgctaatcggagtcataaatatgaaacgaggtaaaaagtgtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactggttttttagatattgtaaaagagtatgaaaacggcaaaaaatgattgcaggttgaaaaatggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaacatgaattagtcagattaagataaccgatattcgacaaggactaattgccgagtatcggttattttatagaaaagtttagtcggtaatttggtaattactgttgtctatatcctattgtttggggacgacaacgattcaataagcagaagccaataaaataaattgcttgaaagctcagaacgattccaaaattactcgttctgggctttttaggtgtaagtagcgaccaatcaatcgaactttctggacgctacgtcgtgtgaacgatggattcccctggcacattccgtatctactccgttataagttgcctaagtttattgttctcgaattcgccaaatatgagctgtacagacaagataattggcaaacatattaagaaattccgatggtttagtaaaaaaacgtgaaaaaattagcttatttccgaacgtttgtgttatcattttgcatagactttaaaaatgatgatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacgattttgaagaaagtgtttcaggcccggggaacaggaatcttggaaaccattcccggtgctgctggtggtgcacggtttattccttatattttaaaggaagaggcccaagaatttattgacgagatgaccactaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaatgtgccgtttgtgattgtccgcaatgattctaaaattacggaaggctcgaccgttagtgtgaactatgtctcgggttcttcagaacggatcaagaagatggaactttctaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgggtaaccaacgtaagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatcgatggtcgaccacgtcttgacccaagttgaagccacccacatggcaaatatcgtgaccattgtaggccacggtgccaaagatgtggaagcagcattaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaattatttgaatatcatcaagctaagggtgccgctggcacgattttaacgtccaaggcacctaatcctcaaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatgggggtaaatacccgtgcagctctagcccaagcaaccaaagtgatgcaacaacggatcaacgcgcagcatatggaaaatggggtttcaattatcaaccctgacgatacctatattgatgcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgctgacagcaatattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggtgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggccgcttaccacatgaaccagaaaacatgtaattattatcattgataattgaattcagagaccatccaagtgcgttgttgctgggatggtctctttttgttagctcatcggcgtgacttgtggtgtaataagggctatttagctgctaaataggacaaagttgatttgactgtgtcagttcagggcaactgagtgattttaattaagtcacgaaattggtataattggcgaggagtttacgggacggggaagtttggaggcatttagatgcagacgaagaagtggattcgcggccttgtttgtggtctggcattgcttggcggttggagctgggcattaccagtacacgcaactagcgttaaaagtgagcaaacagccgttaaaaaaatcgcgcaacgtgatttgaaatcactaggtgggcgctggtcggtcaaggtgacccgattaggtcgacgaaaactaaccgtgcaaacgggaaatcagcgcatgactcgtcaacgttctgctagtacgatcaaagtttatgttatgctgacgatttatcgacgggtccaacaacgaaagttacggctaacacagcaagatcaaaatgatttaaaattaatgattcataattccgataataacgcggctaaccggttgatcaaacgtgcggggggcttcaggggcgttaatgcggccattaagcattatcgattcaagcagacggttttacaacggtatatgcttgatacgaacgcgctacgctggggacgcgataattacacgtcggtggctgatctaactcgttttttaacgctgacatatcaacataagttattaggtaagacgtatgataagaagatgttgaccttacttaagggctgtcgcaaccacagcaagctaccatacttagttaaacacgccacggtctataataaaactggcgaatatcccgataagggtgtccaaaacgacgcggccatttttaagaccaaacaaggcacttatagcattgtcgtcatggcccagaatggcaagcagtaccaacaatatcaagggatgaatcgtttggggcgcgatgtcgtgacttatttaaatcagcaccactgagtgtgtttagataactgaacagtttagtagatccctgttcgtcagccggtgtgcgctctattccgacttctaggactggttacttttgaacgcgagaaacggcagcggtcaagtaccaactaaggcaataactggtacaatgcgtgtgtcagtaccaattacaactgatagcggtctcattaactaagattgttcggtaatcggggctcacgaaactttaatctttaatcacgaaggggcttagattgccgaaagtcgtgcttccagcccagtctcacgcaattttgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttgggtaagacttcggtcgatcgctttagtgatggcgaaattcgcattaacattgaggaaagtattcgtggtgaccaagtttatatcattcaatcaacttccgctcccgttaatgacaatttgatggaactattgatcatgattgacgccctacgtcgcgcgagtgctaagaccattaacgtggttattccttattacggatatgcgcgtcaagatcggaaagcacgttctcgcgaaccaattaccgctaagttagttgcaaatatgctggaaacagccggtgcaacacggattttggcactcgatcttcatgctgcccaaattcaaggcttcttcgatattccgttggatcacttgatgggtgcgccgctgttagctgactacttcctgaaccaccacttggatgaaaatgctgtggttgtttcacctgaccatggtggtgtgactcgggcacgtaaattagctgaattcttgaaggcaccaatcgcgattattgataagcgtcgaccacgggccaacgttgccgaagttatgaatattatcggtgatgtcaagggtaagcgggccatcatgatcgatgatatgatcgatacggctgggacgattactttaggtgcacaggcactggttgatgcgggcgcaactgaagtttacgccagttgtacgcatccagttctgtctggtcctgccatcgaacggattgaaaagtcaccaattaagaaattagttgtgacggattcaattgaattaccagctgctaagcgaatcgataagatcgaacaagtttcagttggtcaattaatgggtcaagcaatcaagtttatccatgaaaataaaccagttagtccattatttaagaatcgtttccataacgaagaaaattaattgacgaagcgtcaaattggcaattgctgatttgacgctttttaagttgcagtaatttctaaaagtgatagagtaaaggtgttgtttggtgggcattgtgacctagtcaaagttggactggacgctgtatatcaacgaatctttcgttttggcgtgcttcaacattaattaggtgatggcgcggaacggataacggaccaacgtcgggctaccggcgtcctttttttatccataaacactagcacgaatccttaaaatgattacaatataagttaagggggtgttgcgatgacaccgttttattggggtagtttggcccttgctagtgcgttgaccttgcaattgacggaccggcggcattggttaacgggacatctttttttgattgcagtcattggcattttgttaagcgcttaccatcgattcagtgcgcaggcaagtcctacttggcaattcatgttggtcggtgcaaaaatcttggcttatacgttgttgccaattgtaattttgattgtgggcattagttttgtcaggtatagttaccgattgattcgcaaggagggctgggcgtttcattacagcttgctagcaatcgtcggtggtgtattagtcataatgctggtcttatcagtaatcaacttaggagtttggcattcgcgacgcttgtggcagttattaggcctagcgttattattgacggcgtattttgcgttcagctttatcgcgtatctattagcttgcgtcatgacccgactaggacgtcatcgacagatcgattatatgatcgtcttaggagcagggttgatgccaaatgggcagccaacgcgaacactggcatatcggcttcagacggcagcgaagtactaccgggtgcaacgggcgcgttatcatcaaccaatcacgatcgttgtttctggtggtcaggggccggatgaggttatggcggagagtaccgcaatgcggcagtacttagtggatcaaggggtcccccgtgatgccattcaagaagaaaatcggtcaacgtcgacaattgaaaatctaaaattttcgcacgcattaattgtgcggcaacaaccgttttatcgcgccgtgattgtcacgagtggctatcacgttttacgggctaatatttttgctcggcaactgcacctgaacctaacgggaatcggggcgcatacgccactgtattatttaccgtttgctatgtttcgggaatacttggccttaattgtgatgtatcgctgggccaacttagtggtggtacttggtttagcggcttattatgtcgcagcgttagttaggttaatttaacaaagccgctactcagagctttgaaaaaaatgacattgcgattaatggtataatggagaatgataaaaaggaggggtttgccgtggatcatgcctatcgatcatcttggccactgtttgtaatcgtcctgattggattgattacactttcaggctgtgccaaaaataccggaggcgtaaccgcaagttcggcaacgaccgcaactggtaacagtacaacggccgttttaaccaaagctgatcagcaaatttcgcaacaaaaaattgccgctgcccagaagactttagcgggtgcttctgaatcaactccagcgatcaaaaagttagcccttgggttaaagtattatcaggaagctgaagaagcacttgataataatcagctcagtctagcaaagggttattttgacacgttaagtagttatgatggcacgactgacgccagttttattgctgctcggcaaaagctcgtcaagcagtaccaggcggtcaagctagccaatggttactataacgctgcccgtgatgaattaagtattcatgatttggccactgcgaaggccaatattgataagttggacgatgtgcaagccacacatccggttatcaaaaaattacagaaaaaagctttggcaatgaaacaagccattatgaattatgaggcgtcgcaatcaactagttctggtagtgatagctcaacggttgtcagttcgagttctgcggctagtgcgagtgatagtaggacgtcttcaagcagtacgagtagtactagtgccgatagttcaacgatgacaagttcgtcgaatagcagcacgtctgccagcagtagttcttcagagctgacaacttcggcgatcatcaaacagtttcaggatgcgtccggtgttacgtttacttcggataccgaatttaatattactaaggagaccagtgcttattatcagattaccgcaatctatgcgacgaatgagtctagttcttctgcttccaagacagtaacggatacttatcgttattatccggatagtggtagtgttactaaggaaaatagtgcaactggtagtttcgaataaccagcattaaaaagtgacgatcaggtaatgactgatcgtcacttttttgcttgactggattgtttagaaaacgctgggtagcggtcataacagtgataaaaaagcaacgctcacgcacgttaaaaacgagccattagcgttgcttgaattagtttgaaaaatagtagcttaggcgagtgcccaagtgttaatggcgtgtgcgaccccgtcttcaacgttagtcttggtttcataacgggcaatttgcttggcctcatcaatggcgttacccatcgcaacactgttggttgcgtaacgcagcatactcaaatcgttaccttgatcaccaatcgccatgacttcatcagcagttaagttcagatggtcggtcaacgtggctagggcgttacccttgctagcggcgggattcatgaattctaggaaatacgcttctgagcgaacaatggtaaagcgcttggagaatgacgctggtaattgcttgatggctgcatccagtagtgggccgtgatcgatgaacatgcacttgacgattggtaagtctgggcgcatttcttccggtgtccggaaccgaatcggcatattgacgagtgcactttcgccgaccgtataagggctgatatttcgattggcggtgtagatatggtcttcactttcaacgtgacaatggatattgagtcttcggctgagcgtttcaatgtcgatgtaatcgtcatgtgacagggtaagtcctgtgatgatcttaccggtaattgtctgaaccattgagccattaaaagtaatgacgtaattatcttcaccagcgattccaagttgctttaaaaagggcgtgacgccacttaatggccgtcccgtacaaatgacgactttgattccttgcgcgttagcggcgttaatcgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctggaattcttggtaaattggtttaaataaatcgttttcggcgtttttgctgagcatttcttttggaaagaaaaaccgctgatcgccagagactttcccggtgatggctcgcactaggtcactgacggtggatagttctagtaaggaaccgtctttttgttgcagttcaatctgggtacgcggcttcttcatcttaggatcataggcgtcgtaaggaagatcgtaactgtcgttgatgtcagtgtagtagtgcgtatcaaagccggcttgttcaattaatttttgtaacgttggaattagcggttgagtcgttgcatcgactcgtgctgattttaagggacgccggtctaagaaacgggttgctaggtcagcgagaatttgatcacggctatcacgccaatggctaaaataagtgtttaagacgccatcgtctaaccgtaaataatcgtgtaacgtaaagttattattgaaaaacggcaataacatcactggtgtggcttcagcgtcgaccgcgtggctttgataaagatcgttagcccgttccagtaggcgatctaggatgacttccatggaacgtgatactggatggaaatagacttgcatgtacatctggaagcgactgacaatgtaatcttcgaccgcgtgcatgccttccattgcaaatgtaatgccgccttgatacggcttcataacgcgcaaaatacgggtcaaatcaaaattgccgtaattcgtacccgtgaagtacgaatctcgcagtaggtagtccatccgatcggcatcgatttgactagaaatcatctggacgacttggggattcgggtacgttttttgaatgacggccgcaacttgggccgggaagtcaggtgagacttgctgtaagacctgattgacctcggtttcaggtgatgtcaaaatctgaacagttagggcttcatggtcggtgtgaaagatgtgctcgaatgtgtgtgagtatggcccgtgaccgatatcgtgtaacagggcggcgcatagtgcgaccaatcgctcgtgatcatcccaaccaccgtcaccaggggcctgggtcgggtagttacgttcgaagttatcgcaaatacggcgtgtaatctcataaacaccgaggcaatgtccaaagcgggagtgttctgcaccgtggaaggtcagcgaggtcgtaccgagttgcttaatacggcgcagtcgttgaaattccgaggtgttgatcaaatcgagaatgacttgatgttggatataaatgtaatcatggaccgggtcacgaaagactttctccatgggtaatagttgctggcgatagaccaaattaattccttctttcagtgatgcaagcgttgttgtcggcgttgcatttgttgataggcttgatttaagtgtgcttgaaattcaggttcttcggtgactaacggcaaacttgttgtgtcgaccgtcccatgttgagctaggatggctataaagcgagcttgtgtagcggtagtgtcagtcggcgctgccaaagcgtcagcaacggtcgtcatgacttgtggatcaacatctggaaaccgcgcgtcatggtgaccggctaagctgacttggtaaaaacgctgaatgagttgactacgggccatctgatcgccatcaacgctgacatacagcatgatgaccagcgcttcggcagtgcgccgttgcgacattccagcaattttacgaccggcaatactcaaatcataatcaccaggacaataggagcgtgtaatctcaccagtcgtgatatttaattgtggccaaactgcctgaacgtagtcgaccatcaattgatatgccgctgtaattgaatagcgttcacgagttgctggaagaaataaggagacgtttagtacaccagggtcagcaactacggctagcccacctgaattacggagcatgacctgataaccggcagcgtgtagatgtgctaagccagcagttagccgtggcaagcgttggtctaataggccgagaatgacggttggctgtaactgccagaaatgaacgattggttgctgacgagccgccgttaaccacagcagggcgttcgtgtacgcaaaactatccagcatcgctgccggttcgtatttttgactcaaagttgcaattgtcgattccgtcaagaaagccaccccgttatccgttgttatcgggcacgagggatgtctcatgatgaaaccgccaccgttgtccgtatcatcactaattatactagaaaaatggtaccgttgcattggcttagacaaatcaacttaatctgtagcataccatcataggataatgaaacgtgcaagttagttggctttttgttcgtcagcaacgtgcggcctattttgacctccggggctgagggacaattgttggaacacagccgactcaaaaagtttacgcgggttcgaacttttcccagcagatctaagctgaccgcttttagtcctatttttagttattttggcatgaatggcttataattaaacaggaagttttacgatgggcgtgatgggagtcgcgcggtcgtgaacgctgaaaaggatatagcgagtgtggtaacacggtgatcgtagacgggcgttcagcgtgtgattttgaaatattaggaggtccaaatatggatgatttaacaactggtgtgccagtggcgattcatttagagacgcaggcacggcaagatgacgatacggcgaactatgcactggatgtcgatggtcaattggttcagatgggtgacgcgttttatttacggtataaggaagttaacgatgatgcgccagaaccgattccagtgacgattaagctggcagctaatggggacgtcgtgttgacgcggagtgcggagaaccgacttcggttgcacttttccaatggtaaacgggtgcgtgctcattatcaaacgcctatggggatgctacctgttgaaacggtgacgccgatgttacgagtacggctacgtgaacggccattttcaggtgaggtgaacgttgattacgatttatacgcgggtgagcagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaagggaatctccttgtattatcttatttgggctctctggtagaaatacctgagacaaacgatcgtattagctccctatttctgctgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagtcttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacggtgcaagtgattccgcatatcacgaacgctatcaaggaaaaaatcatgcgtgcgggtacgacgacggattccgatatcgtgattactgaaatcggtggaacggtcggtgatatcgaatccttgccatttattgaagcgctacggcaaatgaagagcgatttaggttccgacaatgtcttctacatccataccacgttgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgtccagaacttatcacggaccatcaagattgcgctagtcgggaaatacgtcgctttacaggatgcttatatctcagtgacggaagcactgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggctatcaagtatgcccgtgaaaacgacgtgccattcttaggcatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagctgaagccgggaactgtggcggctaaagcctaccacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaatatcatccagaattcttatcacggcctaaccgtccagaagggttattcaaggcattcatcgatgccgctaaccagactggtaaagtgaaggcataaatttagtacggtagaattaagaataaagcacgccagcgaattgttggtgtgctttttttgttgggcggccacgggcttgattaggtcaccgatattcacagtgacaactggtgttgcgaaaatacatggtaacaataaatggttctcttgataatagaaaaataaaatgataataaaaaactattgacaataaatggcgggaggtatagattataagtgtaaattgaaagcgcaaacataatgggttagtagttaatctgattatttagaaagccaacggttgctgaaagttggttgattggactgatgaatccgccatttagcgtttgacttcatttttaagaggtcgcggtgagacgatatactcgtagagcagtaaattgggtggtaccacgttgataaaaaacgtcccatagtcttttaggtgaagactatggggcgttttaattttaaggaggcttttcgtatgttaaatccaaagtttgttcgtaataacccagaacttgttaagactaagctccagactcggaaggttgatccggctgaggttgatgaatacttacagttagaccaacaaaaccgggatgcaattaccaaggttgaaggattgaagaaacagaaaaaccagttgacggaacaaattgggcaaagtgatccgcaatcggaagcgggccaagccctcattcaacaagtcaaacagctgaatggtgatattaagagtacggaagcggcccaaacggaagtaaacgatcggcttcattacttagcgattcgcttcccgaatttacctgccgatgatgtaccagtcggtcctgacgaagatagcaatgttgagatgcgtaagcacggcgatattccaacgtttgattttaaacctaaggcgcactgggaattgggcgaaagcttaggaatcttggattttgaccgggcagcaaaagtcgcgggcgcgcgctttgtttattataaggatgcgggtgcactcttagaacgggcggtttacagctttatgctagatctgcacacacaaaagcaagggtaccatgaaattattccgccatacttggtgaacgctcagacaatgtatggaactgggcaatttccgaagttcaaagaagacgtctacacggttgaatcttcaggaatgacgttgatcccgacggctgaagtaccgctgaccaattactatgcgaatgaaatcttatctgaagatcaattgccaacgtacttcacggcgatgacgccttgttatcgctccgaagctgggagtgcggggcgtgatacccggggcttgattcgtatgcaccaatttcacaaagtcgagatggtcaagtactgtaaacctgagaattcatacgatgagctcgaaaaattaacggataatgccgaagaagtgttgcgcgaattagggcttgcataccatgttattaagctttcaacgggggatactggtttctcatcagccaagacctatgatgtggaagtatggatgccagaacaaggcgtttatcgggaaatcagttcatgctctaactgcttggacttccaagcacggcgggcgatgattcgttaccggaaagctgatgggacggtcgattacgtccacacgttgaatggttctggacttgctgttggccggacggtagctgcgattttggaaaattatcaacaagccgatggcacggttaagattcctaaggtgctccaaccttacatgcatggtatgacagagataaaataaaattattatgagaataaattattattcaaataattcatttgaatgttaaacttaatatcactaggattgagatggatacaggctagggctgttatggtaatctcagtcctttttaatttggcgttaaaaatgcttaatttttataatcgaaatcacatgaacggtaattgtcaccatgataatattttatcatgaagaaaaggttttcacggcactaaagtgatgtttatcacaaagtggcgttttacaacgagtcgagacgttaaatctaatgggagggttattcatgcaggttatgttagcacattctctggtgtgaccagaacaacgttataaaaaggagatttaaaaatgacaaatatatttaagggttggagaaaaaatgatactttttggatgctgagtttgttcggaaccgcgattggggccggcgtgctattcttaccgattggagttggcacggcaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtgcttgttgggatcctcattggaattgctcgctttggtacctctttgattaccaaagttatgagtggcctggcctttccatttattattgtaatcgttctgttttccttttatcttattccacattggaacggcgcaatcctctcaacattttccagttccgtatctgggggacatttggttggcactttaggaaacttgtggttacttattcctgttatgatcttttcgtttaaccattctccgattatctcttcattttccgttgccgaacgtaaagaatatagtggagaaggtaaggacaaagtcgataaaaagatttcgacaattctattgtcggccgaaacgttgatggtcattgtcgcaatgttctttgttattagttgtacattggcgttgactccagatcaaatccttgaagctaaaaatgaaaatgtttcaatccttgattacgttgcgactgctttcaataatccaattattaaatatgtttctcccgtaattgcctttattgcaattgctaagtcctttttaggacattatctaggaacgagtgaaggcttacgtgggattattcgtaagatggaagaaaaatctaacaagacgctttcaagccgaactgtttcgacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttagtaatctgactaaaatacgagatgaattcacattggttaatattattgaagccaatttttgtcataaatctcgttgctagtgttattgacgagattcgcatgacggtgttggggttcgtgagggtcgcgaatcgaatgaccatactggaggctggattaatcacaacggcggaattaattcagaaatgaaagctttgatgcaacggctttatgttttctgatcagtacaactgtggtgcttgcttgtgccgtaacttcaagattcataaagtttcgaaacgatgtactgacgatgaatgcgcaaagaagcgctagttgcccgtaccaaagcttaatttaacgtgatgattcaaataggaggatgactaaaatgacggtgaattacaagagtgtttttgatattattggcccgattatgattggaccttccagttcccatactgcgggggcgtgtgcgattggtcgagcagcgaatagcatttttcaggagaaaccgacagatattgtcattcattactatgaatcatttgcgcaaacccacaagggccacggaacggactatgcgattatcagtggcattcttggttttgatcctgatgatagccgggttccatatgccattggtttggcccgagatcaggggataaatattacctttatcgaagagcctggtgatagcccaatcaaccacccgaacactgccatcattgacttaaaaaatgatgataagcaagtgacggtcgctggatgttcaatcgggggtggaaccatcgaaattcgtgaaatcaagatggatggttttgatgttaaacccaaagggccacttcctatcttgttagttcaaggtggtgagaatgaccatcagcacgtaaccaaacagttggctgatctgactaaagtaaacgaccagcagcagtacaagacggctcggggcaatttatatgaatatgatttggatcgccgcctcaaacaggatgaaatcaaaaaattagcgcagggacacgcaaatttagtttacttataatcagggaggtcagttatgatgtacatgagcgtagcagaactggtaacagcggccaaggagaccaagaagccgatctacgaattaatgattgaacaagagatggaaacatcgcaaacgagtcgtgaagaaatctggcacacgatgggccggaatctagacgtcatggaagcagctgttaataaaggggctgcaggcgacggggtctattcaacaactggtttaactggtggtgaagctgttctcttgaaaaagtatcgtcaaaaagggcacactttatccggcgatacgatgatgcaagctgttcagaacgcaatctcaaccaatgaagttaatgcttcgatgggagtcgtttgtgcgacaccaacggctggatcgacggggacactacctggtgtgattttcacgctgaaggaccgaatgaacctcaaccgtgaccagatgatccaatttctatttaccgctggcgcttttgggatggtcatagctaataatgctgggattgctggtgcgactggcggttgccaagctgaagttggtagcgcttctgcgatgggcgctgcggccgcggttgaagttgctggtgggacgcctgaacaaagtgctgaggctttggcgatggcaatcagtaacttgatgggattagtgtgtgatcccgttgctgggttagttgaactaccgtgtgttaaacggaatgcgattggggtcggtaatgcgttgattgcggctgacatggctttggctggctgcacgaacaagattccagcggatgaagtcattgcagcgatggataaagtcggtaagggcttgccaaaggcacttcgggaaactggactgggtggcttagcggcgacgccaaccggtattcggatgaaggaaaagatttttggacgatcgactaattcacaagttcatgcataaaaaatgtcgcagaaagatgatgagctgactaaaggcggtatcatcttttttaattagatgtttatatcgttacatgtattaacattttatcagtgtggcaaattctataattaatccgaacagaaattaaaaagcccaaagcaatcacttacaatggtagtagctaattccaaccaatatagggagtgattactttgggtacatctactttatcacgttgtcaactgtgccactagcacaactggtcaatgaggggaataaatcttaccaagtaatggctgacgccttaggcgtcgccaaagctacattagctatgagttggaccgggttaaaccttatgatccagatttagctcagcagatgcagatcgcaaaaggcggaattgcggtcgtcgttcgatgcggacggcagcattagcgactttaattaccaatcacttacgattaccctggtcaccagaaaccattgcggccgcttataacttgagcactgcgtcaatttataattggcttaatcgtggctggctccccttcaattgactgatctacccaatcggaatgtccgccagcaccgagtgagcgaaaatcgtgggaaatttacaagtgggacttccatcgaacaacggccaacctgttaatcaacggttagcttttggtcatggaagagaatacggtgctttctagtcgaagtgagtccgatcatgtctggttacattcgtagaacgtaagacccacttctatgggccatcaaagcccctaatagaacgctaaggctctaaacaaccgcctttggcaagtttatgggggccttcggtccccaagtaaaatccattactgtgatcatggtaaagagtttgccaattatcaggccttagaacaggattatcagatcaagtttatttttgccatccatattcaccatgggagcgaggttccaatgaatattttaatagacggttacgctggttcttcccgaaaaagaccaattttagccaagtaacgactgatgagatcctagcagcacttgaactaattaatcaacgaccattaaaaatacatcatcaacagactgccattgaaagattccgggcttgttcggattaaacttgtaatttgccttatgaattcatccttattgaagaaatgcgtaaaaatctttgcaaaggcactactttgttaaaattcacaaaataaaagagcccagtaaataagtgtttaccgtggctcttttattgctcatagactaattatgccccaggcaggattcgaacctgtacattgtttccaatacagcgacctgaacgctgcgcgtctgccagttccgccactggggcagttgctttaacaacaatatccattatagcgaaaagtaacaaaaaaataaacctttttctatatttatgcagttgatattaattgtaattgtaaattggttgcttagttactggggctggccttaattagcatggaataactgtacgccgaaatactgaaattactaccggcaaaaaatgcatccaaaaagtcacccatcccagcaggttcaacgacactgcttgaatgggtgacaacttgtctgtttattaatttgcttgtttggtcgtgatactaccatctaaataaacaaagtaactattcagataatgcccccggccgccattagccgttttctgataagcatcgacctgataatagtggtggccgtgtgcatcttgattggcagttggtacgacaccaaaggtttgttgcttgggatcgttgagcacttgcccgacggcggccactgcactagttgcgctagtgatatggtcgtcagcagcttgataatggtcaccagattgcttcttagcactagcatcagccgccgcattggcacgactagtttgctccgcgcggttagcggctgcaactgagttcgcttgcttagtggaaatacttggctcagcttgggaagtgcagcccgttaaaaggaatagggcgcagaaactgattaaaattgcccgggtcacgttcggacctccttatttcgtttgttcttgggacaagctcggataaggggcttgtcggatgatgttcgaatcaacgatggtcatcataccgattgacagaagtaacaggatcactaagattaattttttcattaaaataacctcacttgataacggtgattgacctatttccagttagggacccaaatgacgcggtcgatttgttcaggaatgaccgtaatcttggacccagtctgtggcccagcttggacgtcgatcacatatgagatcggaccagcatcaacttcaacaattgagccacgttgaccgtcgacggtgtcgactaaactatacaatggaatctcatcattgctgatttccatttcatataaggtgaattggaggaagtaggactttttaccggtcttgatttttaagggggtgtcaatggcaccgtaatcgggaagggcccgattttgagcgttgggatcattcaggtactgcatttcatcgacagcatcgatcgccatcttccattcaccaccagttaaattagttttggaggagagggtcatgaccgagttagcgtaaatgtcgatcacgttgaaggcttcgtcgacctgctttttcggcagatagccgatggtatagccatgctccgcaacttttagttcaacccgtacggatcgctcagcaccatcaacttcttcaactaactgaatttcaccgatgttagcgttagcgtcgacacggtacttcttggcatagagataatctgctttcagaccagaatcattatagccaccataaggtttaaagtaacctcgggcactcgcatcggccagcgcggcttcaaattctttttggtagtaatctaaaccaatgacgtatgagcggaaaattgcacgcgaattagcgttgatccggcgcgtctgaggaaccgccaccggatggggaacggcttgattcaagcgattccgaaaaccgttattttgagtctgcaacttggtaatttgacggtcttgttcctgattggtcaaagtttgatgaacgaggcgctgccgaattgatttaagcaacgcggcctgtttatccgccgcctgattgacatggtggagatggactaacaccgcaattaagataatgattaaaattagacaggctaagatcagcccggcaataaataaataagttctcataaataattcactccaaaaagaattgcagattagtttaagtataagcgaccagcccactaagcgccaatttaacggctgagcttgtcagggggccgataacaaggtatgatattgctattgtataatatttttgagctagaagaaacggtggcgaacggcgtgcagtggttgattaaaatctaccatcaatatcaatatttttggaaatacgcactgtttggctttatggccgcgctggtgaacgtcttggtattctgggtgctacactcagtcttggcggaacactatttattttccaacacaatcgcatgggtgctagcaactttgtttagtttttttaccaacaaagcggtggtctttcagtccaaatcgcaagacttttggcactggtgtcgcgagttcattagtttcatgttgacacgaggcttatcatattttttcgatactttcctcatgttcgtcggcatttcgttgttgttctgggcacccctacttgttaaaatcatcgaccaggttctcgtgggactctttaactatggaacgtcgcggctgatttttatggaaagcaaccagaaaatgcgaatgcgccagcaaatcatgaaacgtttgagtgatcgtaacaattaattggcatcaggcaagcaagtcgtcccctaacggacgacttgcttttttgatagcatcactttggatcgttaggcagtaatttcaacgacattgatggtttaaatcaagtttcccgtcaattgccagtgcaagccgatgccacaaataatcgttagtaaggtgccgcagacgagtagggtgacaagtccagagttcaaatgactttcctgcttgcgggcaaaggccacttcaatgaggccaatcgtgccaagaccgagtatcacttttagcaaggtcaaccaccagttgcctgataaggttctgattgccaaagccaccccagtgatgataattagcaggtacccgatgcgactaagaatcaaaaagcgattggctgatttgactgagtgacgactgagaccaatcgcaaccgtcagcatgagccatagccaaccaataatgtgccctaataagtacatgacaaaaccgcctccacatttacaattcatgtctaattttagcatgaaagtaggtgttggcggcggtttcttttattgtactttaattaagtttttctgttggatgtaatcgactaattcaatgaccgttttaaagcggttaaacggtgtgacgatgtgaacgccgttgaagcgcgcacagataccatcaatcaattcctttgcaatggcaatgcccactgcccgttcgtttccggtttgttcggcttctgccatgcgtgtcaagataggttctggaatccgaatgccatggacttcatggtgtaggaattcagcattacgccgtgagacgagtggcataacaccaatgaacactggcacgttcacgtgattagccgctagagcatccgccaaagcgtcaacatttgcaagatcatacacgggttgggtgataatgtagtcacaaccataacttaacttccgactgattgacttggtcgatatggaagtgcgataagcgttaggattaaaggcgcctgcgacccgaaagtcactggcttctttaagcgacttacccgttggtccgatgccgctattgaattgcttgatcaacttcatcagttcaacggagcgcacatcgctgaccgaagtggctcccggaaaatcaccgagtttggccggatcgccagtgatagctaagatgtcctcaatacccaggctgtgtagacccatgatctctgattgtaagccgattagattgtggtcgcgggtcgtcaagtgcacgatcggcgtgatgccgtagttcaacttgagctgcgccgcaatcgtcgtattagcaatccggaccgttgctaacgaattgtcagacagtgtaatgccatcgacaccagcggcttttaatcgttcagcaccccggaaaaatttagtcgtatcaaaatcgcggggtggatcgagttcgactaacgccgttttttgggtcgcaactttttgcagaaaccggtgctgactctttgtcgtgacgagcgttggtggctgtggttttgtagccggctggtcatgagcaacgatgctgcgattacttagaccgcggacgcttgcgctggtatgcaaaggtgtggtcccacaacaaccaccaataatgttcagaccgagctgacgaaagcgttcggcatattcttcgaaatagcttggttcaccatcgtagaccaccgcaccgtcctgatcagtgccaggcaagccagcgtttgggtaaacggctagtttgacgttagctggaatcgccaagttttcaaatgactgagctaaatagtaaggtcccaggcgacagttcgtgccgattacgtcggcgccggcagcgttgagttggacgatggcatcagtgaagctcgtaccgtttcgtaagacgccgggggctaacattgaaacattcgtgatgacgggcaagtcagtatgggccttcacgatttttaacgcggcgagtagttctggcaaatcataatatgtttcgagcaagatgccatctaactggttggtggctagaagggcggtaagttgttcagtcacgttggcagcaatcgttgctggggtcgcccgttgaacagttgcatcggtatcgccggctagtccaccgatcgttcccagaatgtaaacggggtgatccacgtgttcccgtgcggtcgctgcaattttcacagcggcctgattgatggtggtgacttggtcttgtaaatcataccgggtcaactttaggcggttcgcagcgtaggtgttggtttgaataatatcggcaccagcccgaatgtacgatcggtgaacgcgtaaaatcgtgtcgggatgcgtcaaattcaggttttcaaaagccgaattgatgccataattaccatataaaagggtgcccattgcgccatcggcaacgaggacccgttgctggagtgcttgtttaaacttcattcaagccacctccttagtggatgctagtggtcagttgggcctggatcgcgttgcgcgcagcaatcatgttctttaaggctgctagggtttctgattcttgccgggttttgagaccacagtcaggattgatccagaattgccgggcgtcgataacgcgtaatgcgcgttggatgttggcttcaatttccgcaacgctcggtacgcgtggactgtgaatgtcatagacccccagaccgatttcttgatcgtacccggtttgttcaaaagcactgataatctccccatggctacgggacgtttcaatcgaaatgacatctgcgtcaagggctttgatggtattgatgatatcggcaaagttagagtagcacatatgggtatgaatctgagtgtcgttttgcacgccggtcgtggtgatcttaaatgagtacactgcttcatccaaataggcttgccaatggcgctgcttgagtggcaaaccttccctaagtgctggttcatcaacttgaataatcttaataccagctttttccaagttttgaacttcttgccggagggccaaagcaatctgattttgaacctgcgccctagggatatcgtcgcgaacaaaactccagttgataatggtcagtggtgctgtcaacatgcctttaaccggctggtcggttagactttgcgcgtaaacggactcagcaacggtgattggttccgtgtaagcgacatccccaaagataacgggtggccggacgcctcgtgaaccgtatgattggacccaaccattttgggtcgcatagaagccagtcagtttttgaccaaagtattcgaccatgtcagtgcgttcaaattcaccgtgaaccaggacgtcgaggccgaggtcttcttgcagcttgatccatcgtttggtttcagcatgcaggaatgcctggtaatcggcatcggttaaattacccttgcgccatgctgctcgctttgctcggacttgcgcactttgcggaaagctcccaatcgttgttgttggcaggaggggtaggtgtaaccggtcgtgctgtaacttaatccgggtcgcaaatggcgcctggcgttcgaatttttgattactcagttgcgcttcagcggcgcgaaccgactggttgttgcggtgactggactggttgagggcggtcaagttggcctgattatggtcaaacactgcttgaacagcggcaaccccctgattggctgccacggttaaggtatgcaattctgccaatttctggtccgcaaaggccaggccgcccagtaagacggggtcagccttggtttcatttttggtggtaatgggaacgtgtaataatgagttggcgggttggagccataactgatcatcggtcacgatttgccgtaactgttgaactaatgcaagttttgcttgtagatcactagcccagacgttatgtccatcaataatgccagctgcgagaattttgtcggttgggaagccgtggtcgaccaagtgcgccaggttttcaccatggtcgtgtactaggtccagtccaagtccttggattggccaggtcacgatttggtcgtactgatcaagactgtcaaaataagtttggagttcgatttttaaggatgggacagccgcatgcaaatgttcaagtgcagtttgataaggtgcgagttccgcaaccgtcgttgttttgactagggtcggctcatccaattgaatccattttgcgccagctgtcgctaattcttcaaacacttgttggtaaagcggtaataactgcggtaatagttcgttgacggcggcgtcatccaagtactgtccgtgacgtttacccagtttaaggaaagagatgggacccagaatgactggtttaccatcaatgccaagttcttgcttagcttcttggtagtagcgtagccagcgattatctaataacttaaaggacacgtcatcgaattcaggaacaatgtagtgatagttgatattgaaccactttgtcatttcggccgcaacggcggtatcagttccacgggcaattgcatagtagtcgggcaagtccaactggtgatcgaagtgaccaaagcgacttggaatcgcgttgaatgcgactagtgtatctaaaacgtgatcgtaatccgaattgtctgcgaccggaatatagtccactcccaagtcgcgttgctttttcaagttagctaggcgtaattttttagcagtggcgtgaaaggtcacgttgtctaattgtcctttccaaaagtgttccaataagtgcttccattcacgatgttcacctaaacgtggataccccaagttactattaataattgtcattaaaacccactccttatatttagcaaattattttaaacgaaaaaacgacaacctcatcctgattaaaggacgaagttgtcgttcgcggtaccaccttaatttgtcaacacctcacgatattgacctcaatccgtacgtttcatacggaagcttattaacagtagctaactgtcatcacctggcaaaagctcagtggtgccgtttggaggccatttttcatcaatcgtcttccggtttggtttgcactattccaaactcactgcacgggtagcgatgattactttcctcttcaggacgtttacatgttttatgattgattagaaaataccaccaatttctaatttagtcaaattattttttaatcttttgaacatattcaaggcgtaatgtgacgcacacgctatttggagccaggcaagtaggaaacgtagtgtgaacagccactagtctttgccagcaaccgttgtcggatttcgaccacttgagctggtgaatagggttgaaacgcagctcccacatggttgggttgacattttaggtcttcataacaggggcgttgcgctaagcattcaattaaggattaagttggttaagggtgctgacgatattgagtgaaatcaggtgctttggtaatcaatgcactggtataaagggattttaatagtcctaaaatttgaatatttcatcaaaactgtggggagatgtcctaatctacacccagcagattaccgggtgcgtacttgctaaaagcactaaatttcatgaaatcatcatatttttttcgagttaagggtacttattttcacaattaacttgctagtatatttggtgagcccactagcgaagcaccaaagatcgaataaataataatgattaggatgatgaagaatgagtcaaagcttatggcaacgattgtttaatcaccgtcaacaaacgaagcaggccgtattaattcttgggagtggccgttccggaacatcggtaatgactaagtgtgttaatttgatgggcatttctctcgggactgataacctgctggcacctagtaagcggatcaatccgaaaggctattttgaaaataaagatgtcatcaatattcacaagtcacttggaagtcgcatccggtaccggccagccttcaagggttactatgatagcccgaagattaaaaaggaccgggcggcgttaaccacgtatctacgaaacttttttgagaatgaacaatatctggcgattaaagacccacggatgaatgattatattgaattgtggcaacgtgttttggctgacgttgaggttcagccggctgaaatcgtcttgctacgtaatccgatggacgtggtcaattcgaatgagcgcgcctggcaccgcgataccacgctcgcaatgcgtcagtggcaagtccggacgttgctttcattacgtgataccgaccgtgagcaccgcattttagtcacgtacgaagatttgtttggtcagacgttgacgacgttgaaacgaatcgcgacccaatttaacttaccgtggacgagcgacgaggcggccctccaagcgcaaatcgatgacttcatcgatccagcactccaaaagagtgatagcggtgaaaatttagctgattttgaagctcgaacggacgtggaacccgatgttaaggcactttacttactaggccgtcaagctgcggctgacccggattactttgcctcggctgaatttcaacagcgcatcgacgagatgactgacgagtatttagccaagtatggcgctttatatcgggactttaacgtcaagatcaatagcaaaacgttctttgtattcggcgaagatcaggcccaagttgatcaggtcaacacgactttacgaaatggtcaagtcaagatggtcggcacagaagctgacagtcatgaggttgctgaagatttgagcgaacggttgaataataatacgattgccattcagacgtaccccttggactatttagtggtcgagcaaaaggaagccctgaataattatctccgtaaaaacgcgaaacgcgagacgttatgggggattggggatgctaaaaacaatgaaatcgttgaaatgttaacgacggtcagtgccgagttaggtgcggatacgcacaacgtggtgattgcagatgacttaacagccatcattgatgaacgtgagcgccgattagcgattcaacatttagtacggacgttgcacgcggttgaacagccaccatacttggtcctgatggctgacgaactgggaacccctgcgtcgcaaagtgcggtgacggcttttattgctgctgaaccgactaaggcagcaccattacgagacgaacagccggacgaaacgttcaagctgcggaccccgctagacatggatgaggtggcggcaactttaacagcgttgtgtcgacgtgcgagtcaggatgagcaacaacaagccgcattgaaccattttgtaagtcttaattatgatgaaattttaaacgtgaaaggtgatcaatatgcaaacagtgtacggaattaaagctcatggtggtaagttagttaatttaaaagattttagtgaagcaacgcgtcaggctgctgagcagctgccaagtttaaccatcaataattggaatatctcagacttggaattaattgggattggtggttttagccccctgactggcttcatggtcagtgatgattaccattcagtggtcaacacgatgcacttgaagagtggcgttatctggagtgtaccaattacgctgggtgtgtcccaagcggatgctgataagattgaattgaatactaagattgctttgaggggcgctgacggcgtcatttatggcacgatgcaagttgaagataagtttgttccggacaagcaattggaagcccaaaacgtctacaagaccaccgacgaagcccatccaggtgttaaacgcttgtatgccaatggtgacgtctacttgggtggcgcaattaaattgttgcataagccagatcatggtgcttttagtgattattatatggaaccattagaaactcggaagatgttccatgacctcggctggaagcggatcgttgggttccagacacggaatccaattcatcgggcgcatgaatatattcaaaaattagctttggaaaacgtcgatgggttattcttaaatccattggttggtgagaccaaggcggatgatattccagcagacgttcggatggaaagctataagacgattctgaagtattactatccagaagaccgtgttcggttggtcatttatccagccgcgatgcggtatgctggccctaaggaagccatcttacacgcaatcgttcgtaaaaactatggttgtactgattttatcgtcggtcgtgaccatgctggtgtgggtgactattacgggacctatgaagcccaagaattaatcacttcggtcgaagatgagatgggcatgcacttcttcaaattcgataattccttctactgcaaaaagtgtggttcaatggcaacgcagaagacttgtccacacggtgccgaagatcacatttcattaagcgggacgaaggtgcgtaagatgctggctgatggtgttgtaccaccaaaggaagtttcacgtcccgaagttgcccggggtctcattgatgggttgaagcgtaaacgtgaacagcaacaggaggtctaagcatggtaaaatcagataatattacttggcatcaatcgcaagttagcaaggccgaacggcaagcgctgaaccatcataagagtgtggttttatggtttactggcctgtccggctccggtaagtcgacgattgcgaatgccgttgaaaaagcattatttgaccaacaagttggtagttacgttttagacggcgacaatatgcgttttggcttgaataagaatttaggcttctcagctgaagaccgtgaagaaaatattcgccgaatcggcgaagttgccaaactatttgtcgatgctggcgtgattacgttgacggctttcatttcaccatatcgggccgaccgtgataaagtgcgggcgaaccttgaggtcgatgagtttattgaagtgttcgtcgacacgccgcttgaagtttgtgaacaacgagatgtgaaacaattgtacgcgaaggcgcgtcgtggtgaaatcacgggctttacaggcatcgatgcaccatacgaagcacctatcgatcctgagattacgattgacacgtccaaacaaccactgaccgcttccgtccaacaagtattgaattacttggcggaacaccattatgtcagtttggttactgcaaatgaaaactaatgcaatcattactgacatcacaaaatcgattgtgaaaatggaccgaatcttggtctatcgtcatacgaatccggatcccgatgcaatcggggcacaatttggactagtcgccttgctcaaagcggcttacccggagaaacttgttgtggcgatggccccagttccgggccatttggcgtggatcgatacaaccgatgagcagttagtgcccccccaagcaacggacttagtcattgccgtagattgtgctaaccatgagcgcctagctggggagttgccaacaggtgcctttgtgattaaaatcgaccatcacccgaatcacgatccctatgggcaactgaactgggtcgatgaaacttatagcagttgctcggagatgatttatgagttggcgcaagcggggtgttttacagtgacggcggccgttgcaaccaagctatatgccggaattatcggcgatacggtgcgcttttcaactcccgagacgtccactcgaactctgaagattgctagtgcactcgcggcaacggacattgatattgccactattagtcaccacgaaatggacttaacgccagcactcagcaagttgtatgggtacgtcctgagtgaacaaactattgagccaagtggtctggcacacgttgtcttaccacaacggatatttagtgacttgagtctggaatatggcgatgaggatgcgcttgtcccgttgcccggtaacctgacgacggtcaaagtttggttgttcttcattgaaaccccacaggggcaataccgcgtacattttcggtcgaaagcaatcaatgtcaatgcggtcgcaaaagcgttcaatggcggcggtcatccgttagcaagtggggcatttgttcctgacctagcgacagttggacaagtcattgagcaaatgcaggcgcaaatattagctgcgacggccgtagattgagtataataaatttaatataaactgcactgattcggtttgacatggcaattgttagtcattctgtgtcggtcacgtgggttgccacgggaaggttagaccgccagtatcagcggtatgagcctaatattctggctgacaaaacgggcatatcgttggagtagcagtcgtgaggaattgattggcgtcagaaaaaatagtgagatagggtcggtgaaaggtaaatgaaaaagcgaaattggttgattgcactaattgtcgttgtgattgtcgcgattggcggtggttttgggtattacaaatatcatcagtcaactgcaacgacaacgaccactagtaaggtacgttcggcgagtgcaacgaagaaggacatcaacacgcggctagtcaagactgagattaaggcccagtcgagtgagacggcgacgctgaagaaggcggtcgccaataagaattataccgttaataacatgtacacgaaggttaacccatacggggtgtctccgttatccgccaaggtgattttccagacgagcaaggcggccaaggtcagttatacggtggtcggcaagagtagtaagacttcaatttctaatacggtcaataagtacacaacgagtcatgatttgaccgtgctggggttatacgccaacacgaataaccaggtcaagattaaggtgacttataaggatggcacgtcgacgaccaagacgatccgactgaaaacggcgaagttaccatcggcgttgaccgattttaagatcaacgttaagaaggctaacaaacaaaaaatggtcttagggactggtaattcgaagctgacatttatggttcggacgacgatctctgggagcaagcagtctaaaaacttatcgttcgggatggatgcggatggtaatattcggtggtatacaacgcggccaacttcccacattttcaaacaacttaacaatgggcatttattgatttggaccaaatcgaatgctaagaattcatattttgatgagttagttgaaatggattatacgggtaaagtttataagacttataaatttaatcataaggcctggggtaaggctaagggttctaagaagcagaaccataatcaggtccaccatgacgtaacggaattgccaaacggtgatctgattgcgaccgtttccgatggcggccggacctatgtcgaagacacgatgatcgttatatcgcataagacgggtaagatcaccaaggtcatcaacatgaagaatatcctacctgcgaagttctatacgaagtacaacgcgacgaagtccagtaaatatatgggtaagaaggactggttccatcagaactccgtctattatgataagaaggataagagcttgattatttcaagtcgcaaccagaacttagtgatgaagatcgattacaagactgaaaagatcaagtggatcttgtctggtaagaagacttcagcttggccgaaatcgtaccgcaagtacttgctgaaggctagtggtaagattgcttggccgggtgggcaacatgccgccatcgttgatccaagcaccttgggcaagaagaactcgctcaacgtgatgatcttcaacaataacgtggcagttggtacgaccaagaaatcgttggcggactcttctggtaaatattcagaaggtgtcgaatatcatattaatgaaaagacgaagacgatttctcaagttggcagttacggtaagtcattaggtaagaagaactttgccaatattattggttctaatcgttacttgagtgcttcgaatcggctaattgattttggttggttgaataatggtaaatcagctaatattattgaatacgatttgaagagcaagcaacaggtgtttaacgttgaattaacgggtcttccaagcggtggttatgtctaccgggccgaacgcttctcgttgtatccgacgaagcacacgtatggtattaatgaataagaattgaatgtaaaacgggcgcccctgactagatggctcatctggtcgggggcgcctatttgcgtgttgcgctaaccaagatactgatggcgcgatggtcgttagtagcccggtatgaaaatatggctcaatggcggactagtcataatatcggttgatcaataactgcggataatgattgccggttgactagctaggcgtcacttttgaatgcttgataatcaatatttcgtcatccacacgacttcaagcgcgtccgttcttaaaccagttgtcggcccgaaaaggtcgttttcaaagttgtgactgaacgttaatgaaaaagtcacaatttggtcgcaaaatcatccgcaaagctagaataatttcataccatgtcgcatttatgttcacattccaagtctacaatggttcttatgttgaacggcgcgacggatataggttgattatgagcagtggcgcaagactcagcaagatgaaaattagttgaagcggagcgatgacgatgaccttaaatattgcaattgttttaatcacgttattagtatcatttatattaatggccatggaagttacgaccccgaacgccgtaatcttgtgtgccttagcgttcttgatgtttgtcggtatcttgtcgccaacggacccactgtcaggttttgctaacgacgggttagcgacaattgccctgatgtatattattgcctatgccattgccaaaagtaatattattacccgcttatttgaccggattctcggcgatggtcacagcgaaaagcgttccttattacggttgttagcgagcgtgagtgtgatttcaccgtttatgaataataccccgattgtgtccactttgacaccgatggtccagcgttggacgaagcagaaagggatggcaatctcaaagttcttgatcccactatcctacgccacgattctgagtgggttgttgaccgttctagggacttcgaccaatctagtggcacaaggattattgtctaagtacaaattagcacaatttggtacctttgacttggccgtcatcgggattcccatcacgattattgggttgatttacttactgacgatcgggtaccgcatgttaccgacctattatgggagtagtgttgacgatgttgttgctgaaccgaatgattacttgattgaaatgacgatcggcgatgattttgaacacctcaatcaaacggtggtcgccgccaaacttcgtaatttaccgcgctctttcttagtggcgattaatcggagtggtcagtcgatcgtgccggtgacggatgagacgattctacagttaggtgaccgtctttacttcactggaaattttgattgtattaatgatcttatgaatattaaaggtctaataccaagcactcagaaaatcaatatgactgatatcaccaatgaacgggttcggctcgtcgaagtctccattccggacacgtccagtttggtgaaccaaacggtcaaatcagcgcgttttcgcaatgtctttgggagtgtcgtcgtcgcaattcgacgcaacgatgtcaacctcgaagggcatctcggaagtattcgcttaaaaggcggggacaacttggtcatgattaccactggtgaaccagacgagctggcaagtctcaaagacttacacgtctttaattcacaaccagtgaagtcccggaaacatacttataaggatgttttaccgattgttttattggttgcaacgatcatcgtgtcgactatgggcgtgattgatttgttcgttggtctggcggcctcgtgcgtggtacttttcttgacgaaatgcgtttcaatcagcgatattgtgaaggctgtcgatatgaacgtgttgtttttagtggctagtagttatggacttgggcttgcgatgtcgaacgtgggtgctgataagtttatcgcgaagtcattggtagcaattaccgggaatgcgtcaccaatcatctatatgttcctgatttatttcgtgaccaatttcttaacggccatcttgtccaatgcggcggcgttatcactgatgtttccagtggtcgtttccgcagcgaagttggaaaacctacccgtgatgatgcttgttatgttgattacgattgctgcgacggcggacttttcaacgccaatcgggtaccaaacaaacttgattgtttacggccctggacattataagttcacggactactttaaagtcggaattccgttaaatttgatttgtatggtcgtttgtgtgtttgtgtcctattactattatatggtgctgtgatgtgacttaatcgaatctaaaagacttgtgagcggctgctgacaagtttttttgtgttggttagtaaatcggtgacagcttagcacagtgaaataaccttaaaaaataaatcaagacggccaattcactaattaaaataaaatatttaatatttacgaacaaaggactagtattataaatctaaagttgatatactagcaaagtttgcttgtctggcaaagcaccaagaaaacgattacaagtgcgtcatcttaattaatgaaaggagtgcgaaaatgaacgatttaacaaagggaaaaccgctaaaattaattttttggtttacgattccgttactaatcggtaacatttttcagcaattttatagtttatcggacacgttgatcgttggtcagacgttaggggttaaagccctagcggcggttggatcaactgggagtgttcagtttttgatcattggctttgcgcaggggttaaccgctggcttatccatattaacagcccaacattttggggcacgtgattttaaagcagtgcggcgcagttttgcgattagtatcgtagttagtctaattgttgggatcattttgacgattctgtcgttgatcttcgttgaccatatcttgttgttaatgcaaacgccaacggatatcattgcggatgcgcggacattcttacaaattatgcttggcgggatgctggcaccaattgcgttcaacctgttgtcaaacatcattcgcgcactcggtgatagtcgcacgcctttatggtttttgattatcagcgcgttaattaatattggcttggaattgttattcattttggttttcaaatggggcattgccggggcgagctgggcaaccattttagcacaaaccattgcaacgctcatgtgtgtggtttacatcatcgtcaaagtacccatcttgcacattggacggcgccacttcaagttagtttggtcggaagtgaaggctcacctgaatgttgggttacccatggcttttcagatgtcgatcattgcgattggaacgattgtgttacaagcggcactgaatagtcttggcactaattcagtggcggcgacgactgccgctcagaaaatcgaccaagtcgcgactcagccattaatgtcttttggggtcaccatggcgactttcgcggctcagaattatggtgctcatcagtatgaacggattatcacgggagtcaaacagaccatgtggctgtcggggagctttagtgtggctgctggtttgattgaaattatctggggtaaacagcttgtggggttcttcgtcggtcatcaggacatggcggtattgaacttatcccagacgtattttaacgtcatcgggagcacgtatatcctattatcaatgttatttattatgcgtaataccttgcaagggcttggacgcagcgcaattccaactttggcaggcgcggcggaactctttatgcgggtgtttgcagcactgatcttagttcggatcttcgattacgccggtgcttgtagttcggaaccgttagcttggttagggtcgtgtgccgtgcttttgcctgcttatattaaatcagtccacgatttacgacaacaggcccgcatgacaaacacggtcgcagaaggggccgaaccaatattaaacgattcggaaaaattgtaattaaggcttgcaaccaagtggattatttgataatatttgttatcaattttattttaaagtcactcatataatctcccggacacctgtggacggggcatgaattgaaaaacgttaaggagtttacaaatggccgtagaattaaaaattggcgattacgtcgctggtaagaagtttgcttcgttggaacatgatttcaagggtgaaattgaaaaagtgtatgaaaattcagtcttgatcttaattaaggaatttcaaaaagctgacgaaccaattgttaacgagtataaccaccgtgcagttgttcgtaaggatgatgctaagctcattaaagcggcgccaaagccgaaagtcgtcccagaaaaagaagactaaaaatttataaataaccatgacaacagaaaaaatgtatgctatactaatttctgttgtcaaatgcgggtgtagtttagtggtaaaattcaagcttcccaagcttgcgtcgcgggtccgattcccgtcacccgctttgctattaatcatttcggttagtagtcattgtattctcaagctccttgagcgcatggtccgttggtctagttggtttaggacgcctgcctgtcacgcaggagatcacgagttcgagtctcgtacggaccgtcaatagatgatgataatcaagaacgttagtcagcaatgacccgttcttttttattgagtaaaaatcaagatgactaaatagttgaccgaatgggtgatcaacagtaatcgttaaggagcgcaaatgcaatttataacaacatctttcgatgagttaactgttcggcagttacaacagatttacaagttacgagtggcggtttttgtcgtcgaacaggcctgtccgtatcaagaagtcgacgatacggacttgatggcttggcatttacgggggatggattcaacgggacagctgctagtatatgcgcgattaatgcgtgaagccaaccagcaggcccgtatcggccgggtgatcactaatccgatagtacgggggcacggctacgggcagcagttgctccaacaggcgattgtgcagattcaagcgttgtggccttccacgacgcaaatcaatattcaggcccagcattacttagatcgcttctaccgtggatttggttttcaaccagtctctggcgtttatttagaagatgggattccgcatcagaatatgattttaacgttgaactagtcaaaacggctgaattctgttatactaacgcatggtaaaaatatatacgtctaatgagaaagaatagtacgatgaacgtttagaccagcgagttcgggatgatgggagccgaatctaaacattattggaagcgcgcttttgaagacgacaattcgataataagtggatgtcatatcaattagagtggtaccgcgggcacgtctcgtctcttacatgtttttaaatatgtgagggactttttttgtcccgtaagacagtcaaggaggacaatatggattataaacaactcgtcgcagcggccttagcgccagcactaccagatttaacgcaggaagcgattctagataagatcgaacaaccaaagacgtctaagcagggggacttggcctttccgaccttcaccttagcaaaaacgttacacaaggcacctcaaatgattgccagcgacatcgtcgaaaaagtcgatggcagtgactttgaaaaagttgttgcaatgggcccgtacgttaacttcttcttcaagaaagatgcgtttgcagccgatattttaaatcaagtattgtcgaatggtggccattttggtgatgctaagctcggtgaagcgggtcaagttcccatcgatatgtcatcgccaaatattgccaaaccaatctcaatggggcatttgcggtcaacagtgattgggaattctttggcaaatattttaagtaagttggattaccaacccgttaagatcaaccacttaggtgactggggcacgcagttcggtaagttgatcacggcctacaaaatgtggggaagcgaagctgaggtcaaagctgatccaatcaataacttattaaaatactatgtacgtttccataaagaagacgtcgatcatcctgaaatggatgacgaggcgcgtgaatggttcaagaaattggaaaatggtgatgaagaagccacccatctgtggtcatggttccgctcagaatcattgaaagcgttcaagaagatttaccaacgcttggatatcgactttgattccttcaagggtgaggccttctacaatgataagatgcaagaagttgtcgacatcttggaagacaagcacctcttgcaagaaagtcaaggcgccgaagtggtggacttaagcaaatatgacttgaatccggcattgattaagaaatcagatggcgcgactttatacatcacgcgggacttggccgctgcgatctaccggaaacggacttatgatttcgtgcagtccctctacgtcgttgggaatgaacagaccaaccactttaagcaattaaaggctgtgttgaccgagatgggctttgactgggctgaccagatccaccacattccatttggtttgattacttctggtggtaagaagttgtcaactcggagtggccgggtcatcctgcttgataaggtcttggacgatgcggttgcgttagctcatgaacaaatcgaagccaagaatccggacttgcctaacaaggatgaagttgcggatgcggttgggattggcgctgtggtcttccatgatttgaagaacgaacggatgaacagctttgactttaacttggaagaagttgttcgtttcgagggtgaaactgggccatacgtgcagtacgcccatgcacgcgctgaaagtatcttacgtaaagctggtagcccagaaattgcggcaaccgagcaaacgttaagcgacccagccgcttgggataccttgaagttattgagtgaattcccagcgactgtagtacgtgccagcacggaatacgaaccatccgttattgctaagtatgcgatccacttagccaaggcatacaacaagtattatgctaacaccaaaatcttagttgaagatgatgaattaaacgctcgtctggctttggtcaagagtgtcagcatcgtcctgaaggaagcccttcgcttacttggcgttaaggctcccgatgaaatgtaattcgaattaactgttcaagtttgaacgccacgcatgctataaaacggccgttaaagccgagttagcatgcgtggcgtttttttggttgcggtcatagcggcacagaactcaatgcaagttgtgaaccaatcgcagaaatcgcaagtaggtagcggaggcccactattgtaactggaaccagacttatcgtgtgaagtggattatcagtcgacggatcaaggctttaccgccccggccgagtaaaatgatcccgatcaacggccaagatagtaacaataggcaaccatgaatgacaaaggaaacactgatcgatatcatatcgtcacgatattcattttgagagagcaacatatcacggctactgacgggattgacggcgttatgataaatttgagtgattgtttgatgttgacctgtcgcatcattcagggcacgtgaagcgactgaagtcattcgaaaggggttatgggcaagtcgtggcaataggcacattaggagtggatggccgaataagtatgcggaagtcagatagaggttggttaacgtccaatgtaggtgaaaccggccgctggggtctgcggtgacggcataaaaagcaatcacgaaaaaaatcgcgcaacgaatatagtcggaaccgattaagctgaaagcctttttcatggttatccctccgtttgaggcttggctgtgttttcttcagataaatgctcaaactgggttgcgggcgtcgtgatgcttacaaatgaccgcccatccgagttagtgaaaccaagcatgatttatgtctgattataagtcggtgtgatgatcgaaacaaacattaaaatcttaataaggcaacttccaatactaaaattttaatgacctgtttagtcgtccggggtggtattctgaaaactaattcaaaatgccatattgggggcttggtgatgagctacttagaactaacaaatatttgtaagaactatcaggttggcaaacaaacattcaacgtcttgaaggacattaacttgcagtttgaactcggtgagtttgtggcgattgtcggtgaatcaggtggtggtaagacaaccttgatgaatattattggaggactagaccatgatttcacgggaaccgtcagtatcgctggacacccacttgattatcatcatgagcgccagctagatcagtaccggcgcgaagtcattggctatatctcacagacctacaatctaatcggtcatttgaccgtgcttgagaatgtcatgctagccttagatatgactaaattaagccatggtgaccgattgcggcgggcacacgagctcctagcaaacgttggcttgacggcacaaataaaaaaatacccgcaacaattatcaggtggtcaaaaacaacgggtggcaatcgctcgggcattagccggtgatcctaaaattttgattgcggatgagccgactggtgcgctggatgcagacaataccgccgatgtcatggccatgcttcaaaaaatcgcacgggaagggcgcttggtgatttgtgtgacccattcacagcgcgtggcgggtgcggcgacccggattgccgagttggtgaatggacgaattaagtcacaaccagtgaccacccaaaatgtcggcaccacgcaaacagttgcgtcactacctgcgcggccactacgtattgggtatcagtcatgatggccttcaagcatatgcggcatacgtggatctggaatacgctaattgtcgttggcacagcgattggattattcgccgtcatgcttttcaatggtctggggaccggcataaaagggtatattaatcacgaaatgaatgcgttggtggacccacaatcaattatggtcatgcaccaagcggataacgcgaaggatcgtgatgaacaggctgcggccgtctatgatccagctgtagccggcggtatcgcagcccggatgccggtgttcaccgactcacaactcacagcgttgcgtgaccttaagcacgtgaccaacgtggaacccgggatttcagctacaaacgcaacgattgcgattggacaacaaaagtatgccgcacctgaactgacgacctggacgagtagtgacccgacccggcagttgaaagcaggccacgtggcgggtgacaatcaaatcgtattagataagtcttcaattgcgcagaaatggtcggcaacgcgctggcgtcagttagtgggtcgggctgtgactgtgagttatcaaaccttcaatcaaaaagggcaacccgtgaccgtggcgcgtgtgttgacggttgccggaatagtagatagtacctctgaggtcggtttgaatgcagttaactacaccacgatgcagtcgatgcgttcagcagcacatgtctcaacacagccaacgtttgtgaccgttagaattaagagtcgggtgcagaatcaggtcgtggtcaatgaaattaaccacttatcaattaatggcaagcatccatttgccgcgactagtattgcggccactttggattcgttcaatacttacgttaatattgccactaaagtgttggcggcgattgcggggatttcattaatcgtttccgcactaatgattattgtaacgatgttcatgtcggtcagtgctcggatgcgagaaattggtattctgcggtcgttgggggagcgccggcgtgatattcgccggctatttactagtgaagcgctgatgttaggcattatcagtgccacgttagcgactgggctgtcttatttagctgaacgagggctcaatcatggtctggctaagctaactggcgggtatgcgctagttcagattcagctcaacaatgtaattgcaatttttataatcgcaattattatcgcctggcttgcggctattttaccagcaaggcgggctgcgcgggctaatccgatcaaagccttggccgctgaataacaagtgattggataattatcgtgatggaaaagttatgttaaccagtcaacttgtttgaaggagtggttaaaaactgtgcgggatgtcgcaaaatagtcgttttattcaggggtgggggtcattaattcattagggctggtattaacgacagcagcctgttctaatattggctcgcccagggtacgtagaaacttctgattgagaaaagtaaattagctcggctaggttctgcattactagtcgagctaattttgattaatatcttctggtcgtaggtaactgggaatggttatttggcagttagcgtgtacttgagacgtcgatgatggttctttacaaaccgggtgctagttagttaattgacataactaaacattattagtaaaaactaatttttgagaagataagtagcaatggtgaaattcaattgtatccgtttaaattgattgctatacatgctggcgcttactttttatggccaaaaccgtgtcttgtcaaccctatgcagaattaatccatcgcccacttgacttattcaacgagtgaattaattcgccaacaaacttatcagtgacttctcataaaaagcccaaagtcccccctgttatacatgcaaaacactagtaattcagcgactgtccgggtatgctgttggtgtaaattaagctaaggagggttttgttttgaggaaacaaccacagacactagtcattggtggaacgcaggttgctagtggcaagagcttgttgacactggcgttagcgaacgtattgactaattggaaaatgacggtcaccatcgttagttgcaattatcaaaccgttacgtggcggaccattcaaaagcatcactgccatgagtggcagtcagatattcgaacggctaacgagctcaacaacttttggatagcgttgcagggtgtccagacggattatttattgatagatcttgattctacgggtccgaaacacgataactatacttggttactcaacgagtgctggttgccattagcgcaacaaattattttaacctattcgactgaaacggatgtcaacacgttgttgtatcaagatttaggggccttacagtttagcatggaatacacactgaccaatcctaaaatctacaccgtgttgaatcgttatccagcaccagtagctgttaggtcagcgatgacggccagtgacttactcccattccatcgtcaatttcaaactcggcacgcagaatttgctgcaatgaatttagagccattgggtatgttgactgacgcccgccagcacccagaaaaagttttggcggatgccacgcaaattttaaccaaacttgtggcgtaattatggctaattattgatcaaaacgacacgcgctgtgatgagcaacgggtgctttttttgcggatgccaatcacagcgaaatatgtacaaatctggtataaatgtagtgatgcgaattttgtgggggaaatctaatggaaacgacacgagagcttatttatgatacggtacgcaaattggttttaacggatacgcggtatcacgatggtgtgacagcaatggtcattgctacacaattgaaaatgcaacgcacaaatgttagcgcggctttgaatgccttagtgcgcaaacaaaaattggtcaagactaagacgcggccagttcaatttttattagctgcgtcccacctccaagagccatttacgggactaattggtcgtttaaatagcttgcaacatgcgatcaaactagcaaaagcggctgttttgtatccgagtggtcctttgaatattcacattgtggcaaacggtggggcgggcagtaccacgtttgtacacgaaattcagaattttgttgagcaacggggtatattaacggcagctagcagccccatcattgttaagtgtcgtgattatgcagacgatattcaccaacttgatagtcaattatttggtgagcatggccagctagcgcacagtctttgggcacactccgagggcggtattgttgtgattgaccattacgactatttagatggcccgcaacgcgcacaattgacgagtgtcatggaagccgtggcgtcccataagcaaccaccgttaatcattttagtgagcgggattgatcaggaaattcttaggacgcagcaattgataatgaaaattgaattacctgattttaagcaacgaccgtggtcagaaagatgggcgttgattcgtcgttttttgacgattgaagctcaacaatccaagcggacgattcgattggaactagccgttgcccaggcgctcatgctggcaaattatgatcagaatttgaaaacgatgaaagcgaccatcacgatggcctgtgcgcaggcttatgtccgatttatggctgatgctgaccgtgaagttcgcgtgtaccttgcggatctatcgcccgccgttcaacaagcgttagcgcacgaacgggactatcaacaagaattggcggccgtgttggcagcagctgatttatcgtttgcggccaagtcgtcttcgggtttgagctcagattcattgcaagcgagtcggcaacaagttgagccgggaacaagtcctcgcagtgtccaagtgccaaggtcagttgaacaatcaccgtcagtgataaaaccgagtatcgtccaacagcgtgcgtccaatacgcaaaatttagcacaaatcgttgcgccactaattattaagattgtcaaagactggcaaccagattgtgaacggttattggcacggccgttgaccgagagtgtgtttaatggattatgtttacacattaatgggatgtatcgccaaatgccaacgaccaaacctgcatcagcgacaatgatcacgcaattacagtcacaacatgtggccgaatatgaggctgctgttaaattagcacaggtcttagcgacaaaactagatttgaccatttcaccggctgaagttgctttattagcaacgtttttagttgcacaatcaccagtgacgcgtcatcacccggttgtgctttacgtcatgcaaggaatggggactgcccaggccctgatgcgaacaacgaacacgctcagcgctgtcagcaatacttatgcttatgatgttgacttatcagccgatagcacgatggtgatgaaggcactgaagcataaaatcagcgagattgattgcggtgcaggtgtgctagtcatttatgatatgggggcaatcaaatggatgttgacgaccattcaaggcgaactcgcgaccaaaattcggatgattcaagtcccagtgactttagtcggagtcgatgctgctcgaaagagtgcgcgcgtaatggacgtggacgatgtttatcatctagtgcaagtcgatctaaaccaactgaacgccgaaaagacaacaaaagatgaattgattattacgctgtgtcatacgggtgaggggggtgctgcgcaattaaaagattatattgaccaatattcacggttacagatgcgcgtcaaagcgttggcaattgggcatcgtgatgagttggtggcaaccgtacttagactacaacaggtttatcagattcatgcatttgtcggcacctttgatcctcaattattcggcattccgtttatttcgatggcagcaatttttgaacattcacatcagcagttagatcaagtgctgatgtttcggccggaagctggtcgctgggatacttataatcagatctatcagtattttaagacgcagttcgaatacgcagaagttgctaagttgcagcgtgtgttaccaccactcatggatgatttgacaaccttataccaactaactgaggatcaacaaattggcctgtttgttcacttgggtagcatgattgaccgtattttggctggcaagattgtgacgacaacggcgcaaacgcggaaattagtgacccagtattcgcaagattatcagcaattacgacggtgtctacggccggtcgagcagacatttaaactgattgtgaatgatgagatgattgggacgttactggtcatcttaaagcaattacactaatcttaagtgccacggataatcgtttgagattgatatcaggaaggtgtcagctttgattttgatggggagatgatggttggttctagcattgacggagaagtttttaaatgagacttaaataagtcgcttcaagcagtggcgattgcttgaagcgactatttagatggtcagcgattcgtatgaatttaaaggcctaaccgttgacaaagtatctatggttggctcggtttgcaagttgttgttcggtgagcaatgatttgttgttcgagttgcaataacttgtcagacatccgtccgagtagcagtgcttgactaaaatttctgagtagccaatggtgttgttgtggccgataactgtcaacatcttctagaaaggtcacggttgttttggtgccttcagcaatggtcgaataggtcacggttacggtatccagtggtgaaatagctgtcatttggtacttaatcccacgctgataatcgtcaatcgtaattttaatctgagcggccgttttggcggtcgtttttgtatatgtcagtcctttcttgattgacgttgctgtgagtatttcaccagtagcggcttgaatctctatgagtagttgtttttctaaccagtcataaaattccgtgtttgtgacggcaagtgtgcgaatgattttcatgattcgattatagcgagacattttcgacagttcaaggctgaaaaaaacgcgttaaaatgagtaagctatacaacccgatgaatcagctatacacaatacataaattggtcattaaacctatacactaatagtgatgaagttggatatttagtctaattcagctattatgacgccacgtgtgtgttgatactgctaattcatggaccttaaatctatacacaagcatatgtaagcgcttttgtggttaatgacaaaacttgttacgatatgtttgtcgacaaatacagaaagtaggtaaccggataatgacattagccaataatactgaaactcaagatattgcaatgacacttatcgcgtattctggtgaaggtcgtacgctggcttttaatgcgttagatgcgatgcatcgcgatgctttctccgaatctaagatgttattgaagcaatctagtgaagcactggggaaagcacatgatgttcaaacccaactactggtggctgaggcgaatggtcaacaggtttccattgatattttactaattcatgctcaagatcattttatgacgagtctgttagctaacgagttaatcgctgagatgttaaagatgtctcaaaaatttgaaaggatggtcgatttatgaaggcaatcaacgtgttattagtttgtgcgggcggtatgtcaaccagcattttaatgaaaaagttacagcaatatcgtgacgaacaaggtgttgcagggcaaatccaggcagtaggcttgtccgcgtatgaagatgtctaccaggactatgacgttattttaatggggccgcaagtggcttatcggcagggtgaagttgaggcggcaactgggttgcccgtcgctgctattccaccattggactatgcggtgggtgacagtgcccatattttcaaactggccgagaacttggtgtgatgacgagggattagtattcgggggtgaaggacgatggaacgcttttttaatagtaaactgatggtcggcttacaacgcgccggccagggacttggcaataataagtttattaccgcattacaggcagctatgatgtctttgatgggtattctaatggttggcgcgatctttcaaatcacgatgtcagtacttggaccgacgatgtttggcgtgttatcagcaaagagtattctgttagcctacttgaagattccattccaattctcaatgaattctttatcaatttgggttgttttattcttgggattccattacgccaagaatttaaaaatgacggccccaatcatgaatgcgattgacgcattatttggtttttggattgtggccggtgggttgattgtcagtaagactggaacagttagcattgatacaacctatttaggtgctcagggaatgtttattggcttcgtcgtagtttggatttccgtccgcgttgagaaattatgtacagacaagaatattcgaatcaacatgccagatgcagtcccccaatttctccaagacggttttgcatccattgtgccattattgtttaacgccgtgattttcttgggcgcatcgttattagtcacggttggaacagccggtaagtataatatttgttcgggttttatggaattactggcaattccactgagtgcactgacttcaaccataggtatttttgtcctgtgtatcttgggtgctttattatggacctttggcattcatggtacgatgattttagtcccaattgtgatgccgttagtgattcaagcggtttctgaaaatgccgcattgcaggcagctgggaagccggtggtgtttgcacctgtgatgttgttctcatttatgaccgtagcaggtggaactgggaataccctgccgttagcgctaatggcgatgcgttctaaatctaaacagctgagtgccgttggtaagctgtcaattatccccggctggttcaaaattaatgaacccatgacttttggtattccaattatgtataatccgattatgagtatcccgtttgtcctgaatattccggtagttatgttgtgtgcactcgtactatacaagattggatttttaacaccggggtggattgtaattaccgcgattttacccatgggttttggaagttatctcagtacgctcagttggcgcaacgcattgactgactatttgatgctgattccgtcagcgcttatctggtatcccttctttaaagtttatgaaaagcaactgattgccaaagaggcggcagttgaagctgaagaaaagcgggcggcagtttcgaatcaaggtaatgcgcccatgcaacctgtgaagcctgagaaagaggtgtgaatatgcaatttccggctgatttttactggggtggggctactgccgctaatcaatgcgaaggtgcttatgatgttgatggtcggggcctgactatgaaggatattacgacaatgggaggccttaatcagcgacggcaagtcacttatttgcaagcggatggtactcctggaaaaggggattcaattcctgctggagcacacggagcggtactgccagatgactattatcctaatcagactagtattgacttctatcatcgatatcaagaagatgttgcgctgtttgcagagatgggtttcaaaatgtatcgaatgtcgatttcctggtcacggattttcccacgcggcgatgaaaatgaacctaatcaagcagggttggatttttatcgccaggtgttcgaaactttgaaaaaatatgaaattgaaccattggtgacgatttcacacttcgatatgccactgtatctggaggaaacgtatggtggctggaatgaccgtcggatgattggtttttaccagcattatgcggaaacgctatttacggcgtatcgtgggctggtaaagcactggattaccttcaatgaaattaataatacgatcatgtttctggcattgcgtgccaaagccggtgatgcagattaccaacgcgcttatcaacaattacattatcaatttgtcgctagtgctttagccgtacagcaagcacatgcgattgatggcgaaaataaagttggttgcatgatttgcggtatcacgtcttatccgttaacctgtgatccggcggatgtcttgcagaatcggtacgtctgggaacaaaacatctattactgtggtgatgtgcagtgccagggacagtatccaacctatgcacgacgtttatggaatgagcatcaagttgatttagacattacggacagtgatttagaagccttgaaagccggtacggttgactggtataccttttcgtattacatgtcaacggcagttacaacacatgaggtcagtgcaactgttggcggtaatttttcgatgggcgcgcgtaacccatatctacaatactctgaatgggagtgggcggatgacccggctggtctacaatattatttggagctgatgaatgatcgatatcatttaccactaatggttgttgaaaatggattgggtgccaaggattatttgacagtagatggtcaaatccatgatgtataccggattagctatctacgtaaacatattcaagcaatggcaacggcaattcaccatggcgtcaaactgattggttataccagttggggctgtattgatttagtttctgcaggtacagggcaaatgtctaaacgatacggattgatttatgtggatcgtcaagacgatggtagtggaactctggcccgaatcccgaaggactctttctactggtatcagcgagtgattgcatccaatggtcaagatctgggtccctcggcctcaaattaaatgagtgttgctcagcagttttcgtcgatatcggatgaagactgcttttggttgttcaataagataattagccgcgtcaaacaaaacaagaggataccaccaccaagcaaggggagggtccaagaaccgagcattaagatcaaacggggtgctagcaaactaccaataacggtagtggtgtcgatgacggttaagacccccgtcattagaatattacgattgtttgtggggatttgttggatagtggtgaaaaaactaatgttgatctgtccgcgtaatgcaccaattaagaacatggtaatcataagactggcaaaggtcggccacataagtagtaagcacccaccggtgaaggccgtcaaagttagcagggattgctttgaccatcgttttagcaatagtggtgccaataagatacctgtggcgttagctgttaagaaccagctaagtggccagtgactatgcaacttgctgacgacgagccaaggaacggctactgcaatcgtcgcgtcgaccagataaccgagaacggcgtacagtaacgaccatgtcggccatgatcgatggcggtctagcttgacggtgacaaccgaatccgaggagagattggaacgtgttcggaattgccaatcgaggccggctgaaaccaagaacgctatccccattattaagattagggtagccggtgttacccatagtaatgccatcgtgacgagcattgtcgcgctaacgatggccaactggcgaatctgagtttgatagccgttgacgatttgaatatttacgggcgcaaaaaggtctggcaaaatcgttttgttactgagcttataaaagaccccaattgatttattaagaacggcgacgatgactaaactaagcaagtgatttgccaactaaccgtatttagtgcgtaataggcaccaatgaagagtattcccgtcaaaatatccgtaatgaacatcatttgtttggctgagtagtatttaagtacccgaccagctactaggttcagaccgattgccggcagcattgtcatcgccatgacgttgccgagtaactggggatcaccggtcttttcaatcgttaaccaggtgactaggtaagtaaagctatagaagccaaaaaaggtaattaacatgctgctgagatagcagagtagattatggcggtcgttaggatgtggcctaaattcttttttcattaactgacaaccaccggtgtatgggttgagatgttttcatagagccatttggcatcagcaatcgtcaggcgaatacaaccatgtgaattggcgactttaccaagttgctgggcttctttaacgatgtattgatcgttagcatcgactgggactgagtgaaataggtaaatcccatgatccttgaatgagacccagtaattggcgccttcacccgattgcgtgttaaaaaagtgttgtcctcgttcggcttggatttcaaagtgtcctttgggggtatcagagccatgtttgcccgtagaagcaagcatggtataaagggtctgatcgtgtttttttaagtagattcgctgttttttgattgaaacctgaatgttgatgtcatcgtatttagccagtttgggatacggccgtgacagggagggcttgtgccagtcaacggtctccgggactggcgtggttaccttagttgctgaatgactaactttagtgattggccgattactggcaatagcctggtggtgccgggcaaataggtgtccgaatccggtaaaaatagttaagctaattgcgccaatcgtgacccagatgagctgatgaacactgattttcaaaataccatcccttacaaaaatgattttagtgattttagtttactcagttagcgaacgtttgtttatcaaaattgtgtaaactttgcatatcattttcgtaaaatttcccaaaatgagttgtgatagccattattgctggtgccacgggtaattcggaaatcggcaaattaaagttatttgcagtaaatcagttgttaattagacaatttttccagctaattaaaaaatcgccattaagcagcgtacttaacggcgatttgaatttttatttattgtaaactagcgaccttagctacgattttagcaggcgtttcccattcagaacgttcaaattcggaaacgggcacttcaataccaagctgattttgaagttctagtaacagttgtacggaacccatggaatctaagataccttcatcaaataaattggcatccatattgtttgaaacatcttccccagttaaatcttgcaagatcgatagtaccgttgctttaacatcatccatgatcaaaatacgccccttatcattattgtgaattattcagtcttcattctagcatagttttatcatcgatgatggttaatcaggtgtattaacgaaatctttacttgattaaacgttaaaattggcgtgaattaaatcagttagaattttaatcccctgttcaaagcggtcgctggattcataagaaaagctcagacgaatgtactgattcggctggaaatcgtagatactaccagggttgaagagaacgttgtgcgcagtggcaaggtcgaataatttgggaatattaatgttgtcggctaagcggacccacagataaaagccacccgtgggcgtctgccaagtcgcaaaatcgtcccagtaatgatgcagaatttgttctgccgccgcggccttcttgacaagtacggaccggaaatcagcttgatacgtttcatattcaggatcagctaagatttctgccagtacaagttgtgacagtgagctagcgccgtaatcggtttgcatgcgcacgtcagtcaagcgatcgatgaccggtttggcggccaccgtccagccgatgcgtaatcccggtgcaagggactttgagatgctaccaaaataaataacgttgccagtcttatcgagtgccttcagtggctgtggcggctgctgatcgaaccagacatcttgataagcggcgtcttctaagattggtaagcggtgttcttgtgcggtttgtaagacctgttgacgtcgctcggcactcatgacgattccagtcgggttattgaatgtcggaatcgtgtaaagaatggcatggtgtccctgaatgggggcgttcatctgccagtacgccaagccctgactgtccatcgggatgccagcgagatgggtgtgggccgattgaaagacgtgtaaagatttgacataagtaggtgcttccgtgtagatggtggcatctttgggaaatagtgacattgagaccagttggagcgcttgtaatgatccggaagtaatcagaatgttttccggatgggtatgaatcccaactttttccaagtgacgtgcaatttgttgtcgcaaagccaaaatgcccgcaggctcggtatagttcaaactcgttaactgttcgcctagatgtgcaaaggcccgttgaaaaagtggacggggaaattgttctggtgcgggttcacccgtacttaaacgaataaccgcatcggtttcaaattggttgattttttggagcgcgtgggaattgggcttgaattggcctgctttaacatattgcgaccagttgacgtgttccgccaataagctggaccaatggttaccggaaataaccatcccagagcctggattgctcgtaattaagccgactgccattagttcatcaagtgccgtaattagggtgctacgattcacgccgaattgttcggccagtttacgctgcgcaggaagcttagccccaacggcccaattgcctttagcgatttgttcttgaaaatagttagtaatttgttggtaaattggtgtgctgacctgtttatttggttgccagttgatcgttaaaattgccatggcaaacgcctcctgagtgcccatgcgggcgaattaagctgtcattctactagccagaagtttgatgattgattcaggtggttgggtgaaaattgttaaattggttggctacaaatgaaattatctctattataatcatctctgaattaaaagctagtcggatatgaccaattgattgaacgataattggttggtaaaagaatcgaattggctggtcttaaggaggtcaaaacatgcaagtgtttttacaaggattattatttggaattgtttacattgcaccaatcgggatgcaaaacttatttgtggtttcgacagctattgaacaaccattgcaacgggcattgcgggtggctttaattgtaattgcgttcgatacgtcgctttccctggcttgcttttatggggtgggccgattgttgcagaccactccctggctcgaattaggggtgttgttgattgggagtttattggtcttttacattggctggaatctgttgcggcaaaagaccacggcaatggggaccctcgacgcggacttttcatataaagcagcgattctgaccgctttttcggtagcatggctgaatccgcaagcactgattgatggttccgtgttgctggcggcgtttcgggtgtcaatcccggcggcactgacccatttctttatgttgggggtcatcctagcatccattatttggttcatcggtctgaccagcttgatcagtaagtttaaacatctcatgcaaccacgagtcctactctggatcaatcgaatctgtggtggcatcattattctatacggcgtgaagttgctagcaaccttcatcacgaaaatatagttgcggttacctctgacaatcggtatgctagtcgtattggactttttatgagagggacgatacgcatgaagattgctggtttcggagtggaggcctggttaaacgcacatgagcgtgaagcaaccaccgatattagtcaaagctcaatcgcagccttaacgatggcagaaattgcggctttagaggaccaacaagcaccacaggatttttacgaagaactaggggcggcccggctggattatggctggatcgagggctcaccacgatttaaagaactcgttagtcagttatacgagcaagtgccagcagccaatgttctccaaacaaatggggcgaccggggctaatcatttagcaatctatagtttggtggaacccggcgatcacgtgattgcactgtacccgagttatcagcagctgtatgatattcccaagtcattgggcgctacggttgattattggcatattcatgagtcagcgggctggttgccggatattatggaactgcaacgcttgatccggccggaaacaaagatgattttactcaataatgccatcaatccgactgggagtttactagatcgaacactgttagaacaggttgtcacattagctcgctcagttggagcttacgttttggccgatgaggtctacgaaccactggatgaaaccccgttcgtctcaattgccgatttatacgagcgtggaattgcggtcaacagtttatccaagacctattcagcgcctggtatccggatcgggtggacggcgacacctagtcaagccattgctgatatttttcggaagtatcgtgattatacgatgatctgtgggggcgttttgaatgaccaactggccgttagaattttagcgcaccgccaacgcgttctggcgcgaaatcgggagctagtcagtcgcaacctcaaaattctgacagagtgggtcgcacaggaaccgcgggtcgaattgattacgccacatggcatttcagtgtcgtgtattaaactaatagtaccgatcgatgatgagacgttctgtcaacaattactgcgggataccggtgttttattagtgcctggttcacgtttcgatattccggggcacgcccgcttaggttactgtacggatacgccgacgttacaacggggtctggatttattagggcaatatttacgccgctttgattagttactagtggactggtaaccgtggttgactcattacttttaaataattatacaaatttgtttaagcacattttcctaatagtggcggaaaatgtgctttttgaagttctgtgcgtagtttgccaagtgaatatttgctataatgtattcattacaagatttggggaggtttcgcgacatgaaaaagtcagagcgccaagcagttatcgaacaattaattagtgaatatccgatcgctacccaggaagaattgatggctaagcttaaagcagagggcattgctgcgacgcaagcgacgatttcgcgcgatatccgagagatgcagatcgttaagacgccggatgagcacggtcagacgcggtacgcgatttttaaaacaactaacaaaaatgaacaggaccggctatttgaaacgctacacgatgtggtgacgagcattgaccgtgttgaattcatgaatattattcatacgctaccgagtaatgggaatctattggcggcgatcattgatgatttgaacttgccagaagtgagtgggaccttggctggtcacgacacgatctttgtcgtgagtccgaatacgacggtggcaaagcagctatacgaatcctttgctagtcacattagtaatgaagactgactgtggtgagcagtctaattggttgcactaagccgtcgttcacggtatgattattgtcatcaaaagaggtgtgagatatgaaatatacgaagaaacgggcgcctcgaaagaatcaaaaacaacgcgatgcgaccttcgataaatttaaacaacaacaaaatgagctcaacgctaaccgccggggtgtccggcgcaagtaatggctgagctagctttcaagtatgtcatatggacggctcggaagctttttttgtttatggccgttttatcgtagtgacctttaatctggttacaacacgtggcctaaatcagtgatttcggcaacaactggcaaacatcgggttatctacaaaatgagttgcgtttgattgttgaagattttttcaaggttgtggtcaattactgagcatcggaaaatttatgatacaattgtaaaagctaacaagtaacgcggacgttgtgacaggtgcgtcggctgaacaaggggaagattatgcaaaaaaatggtttttgggccacgatcaaagacggcttacgagtcattggcaattggttagcaccctattggcagcgattcgctgccgtcgtcggctaccaatggcaccggcgacaaatcacacggtggctaattgtactcgtcttgaccgtcatcttaattgggagtgcctatttaacttatgaagccaagacggctaaagttggtaatttacaggcggagctagaaaagacaactgaaatctatgataaggacaataaaaaggccggttcactctattcacaaaagggaacctatgtccatttgagtagtatttcaaaaaacttacagaacgcggtaatttcgactgaagaccgtaatttctataaagaacatggtttctcagtcaaaggaatcgggcgggcatttgtcctgctcgttatcaataagatacttggccgtgactacattagtggtggtgggagtacgttgacgcaacaattggtcaaaaacgcctacctaacacaacaacagaccttctcacgtaagtttcgggaaatctttttggcgattgaaactgaaaatgtctattctaagggccaaattttagcgatgtatttgaataacgcttatttcggccacggtgtctggggagctgaggatgcgtctgaacgatattttggcgtacacgcgtcagagttgtctgttgaccaggcggcgaccttggccggaatgctgagctcgcccagtggttatgatccaatcaatcatccgaaagcgtctacggctcgtcgaaacgtcgtcttgaataacatggtcgctaataataagctttccaaaagtgagtataagctttattcgcaaaaggcgatgacgctgacgaataactaccattatgaaagtggttataattatccatattatttcgatgcggtgattgatgaagcaattaataagtacgggctaacggaatctgacattatgaatcggggctataagatttatacgtcgcttgatcaagatgatcagacacagatgcaagattcttttaaggatagtacgttgttcccggccaacgcggacgatggtacgaaggtccaaggggcctcaattgcggttgatccgtcgacgggtggtgtgttagccgtagtcggtggtcggggcaaacacgtcttccggggctttaaccgtgcgactcagattaagcggcagccgggttcgacgatcaaaccgttggcagtgtatacaccagcactacaaaatggttatacgtatgattcgaacctttctaataagaagcaaacttttggggccaataaatatgcgcccaaaaactatgataatgtttatagtaaatcggtcccaatgtataccgcgttatcgcaaagtatgaatattccggcggtttggttattgaataagattggtgtgaataaagggtatcaatcggtgaaaaagtttggcttaccagttaccaagtcggatgataacctggcacttgccttaggtggtttgacgacaggggtatcacccgctcaaatgaccagtgcctatacagcgtttgcgaatggtggtaagaaaacgacggcccactttattacgaaaattgttgatgctagtggcaatgtcgttgtcgataatacgaagactaagacgaagaaaattatgtccgccagcgttgctaaagaaatgaccagtatgatgcttggcacgtacaatagtgggaccggggctgcggccaagccgtatggatactcggttgctggtaagactgggagtacgcaggctgattacagtacgggttcgggaacgaaggatcagtggatgattgcttataccccggacattgtggtcacgacctggatcggatttgatacgacgaacattactcattatttgaagagtttatctgaaaatcaactttcctcgttattcaagaatgaattacaaaatattttgccgaatacgaataatactagttttggtacgaaggatgctgcgacgctggcaaccgaatctaatagtagtgattcggatagttctgatagtggatcatccgtatgggaaaacgttgagaagggcgctaatgcagttaagaacaaggctaaagactggttctccaaagccaaaagtttccttggcaactagtaaagctagcttctgaacgtactaatgctattcaagttccgttaaaaatgctaaaataatgacgacacatacttcgaggaggaactcacgatggccgtaaatatttacgatactgcgaaccaattggaacaagaattacgtcagactaaagaattcaaggaattaaaggtcgcttatgacacgatgaagaccaatgacagtgccttttcactgtttaaggactttcaagaagttcagatgcaattgtcacaaaagcagatgaatggggaagaattgacggatgacgaagttcaaaaggcccatgatttagctgataaggttggcaacgttgacgaaattaagtccttaatgggtaaagaacgtaacttgaaccaattgatgaatgatttaaatcaaattatcactaaaccagttcaagaattataccagaactaagtaaattaaggatcgaggggcaatgacggaatctgttccgtgattgccccttttttagtgggggttatcatgaaatttctacacgcggcagatttacatttagatacaccgtttcaaggactgagtggcttaacaccagctttgcaggaacggttagtgacggcaccactgagggcactcagccgactagtcgatttggcggtggctgagcaagtcgatttcgtcctgctcgttggtgacttgtttgaccaacagggccaaagtgttcaggcccaggcggcactgatgacggcgctagcgcggttgaatacggctgcgattccggtgctgctatcgttcggtaaccatgattttcaggcggatttaagtcgctggcactttccggccaatgtgcacgtttttggcccgcaggtaacaacggctaccttaacgactgaggcacaagaacgggtcgcgattagtgggtttagctatgcgcagcggtgggtgacgacggaccccgttgatgattatcctgttaaagccacgggcgttgattatcagattggtaccttgcacggtcagattggtgtggcgggtgaccactacgccccgttcaacgttagtgaattattaacgaaacattatgattattgggcacttggtcatattcatcagcggcaaacgctcaattcgcaaccaccaatcgtatatgccggcaacacgcaggggcgccatcgcggtgaaactggggcgaaggggtgcctcattgtaaatagccaggccgatcagaccttgcaaccagtatttcacgccttgactgatattgaatgggcggattggacgccaacgctcactagtccagaacccatgtcccgttcacatatcgtccatcagttagctgatcaattatcattgaagatggttaccggcttaaaattagtaacgattacgttaccagctagtcttcaactgagtgcgatggcggaattagccttaaatcagggggccattctagcccagttgcaggaacaggcaaatgaacattggtggccggttgcgattgagcaagcaacgacggatacgatgaccctcttgtttggtattaacgcgacgacctggcaacaagttggtgagcaggtcgtgaccgatcaagcagtcgctgaacttgcaggcaaactcttggatgaagactttctgaacaccgcgttgctggaagatatgtcacccactgcttggcaacaacaagtggtgcgactcttaaatgatcagtaccatttaacgacgggggtgaatgatgatgcagattaagcgtcttgaaattgcgggctttggcaaatttcaacagcagcagttcgagtttggtgatgggcttcaagtgatttacggcctcaatgaaagtggtaaatcaacaatgcgggcctttattctcggcatgttatttggttttccctcccgccgtcacccacttgaacgccatgaaccacaaggtacgaatcagtacggtggttcgatagagctagtggttgacgagacgacataccggttgacccggttaggtgatcaacccgctaccttggtgaacgtgcagacgcaggccgctcaaccgctggccttacttgacaagtggttagcgccttatgatcgtgaccagtatttgcgattgtttacgtttaaccaggctgaattgacggcgctcaaaactatgcacgccagcgatttgaacgtgcaattacaacaagtcggattggtgggcagtgcaccatggcgagaaacggcgactacgttacggacagatgcggaggcgttatataagccccgcggccgcaaacccaggttgaatcaagcattgcagcactatcgcatgttgacagaacaggtcaaggcggccaagcaacggtacccagaatacgaaacattacaaaatcgattgctggatttgcaggcacaacggacaagtacccaacgtgatttaaccaagttggatcatgaacaacaacagctcgccaatttacgaaatcagtggccggtctatcaacaattgcagcaactgcaagccactaatatgacgacgacactaactacggcgactaggacacgctatcaacaattaagccaacagcgaacggaattgcaacacgccttggcgagtgcacgtcagcaattaagtcagcaaccagttgatacacaatctcaaggactagttggcttctacgtccaacatcaagaccagtttgaccaattagaagctcagttaccaaccctgcaacaaaccttaggccaataccaaacgttgacccagcagggaagtgctgccaaggctgattttcaagcgcaaagtaatgcacatcctgagctgttaggttgcctctctccgcacaaacaggccgcaatcgagaccttgaaggcgacgttggcagcgacggcgaacacgcgtcgccaatatccggccccgaatagtccatcgcttgattggcgcttgattggtggtgcaatcgggattgtcgcgggattattgctaccattaggcggctttaaatggatcttgatgttagcaggtgtggccctacttggttggtttgggatgacccgtagtcagggtaaaccggtgcaagcaaccgaccacttatcagaccaattagtggctgctggtctggcaccgaatctgactgccagtgaagccttacagcaattggaactagtcgcggcactgcaacgcgcacaagctgcggtcacgactgctgatcaagcattagcaacacaggctgccaaactctggcaattgattcagccttatcaatttgcggcaggatggattcctgttgatcaggatcatttaacgacaagtgttactcgaattgcccaattctatgatcaagtccatcaagtgatgcaacagcagaccatgtccggccccgactttgcctttgtccagcggcaggtccagcagttgacgcagcaggtccgtgatctgaccgagcagctacaggcgttagcaacgaccaacggtttagcggatgtagacgcgttgacgcaagcggttagtgatgccgaaaagcaaacggccaacgccacgagtcgtcaacaattacagcaacaactcagttctgctgagctatcggcgttaaagcagtatacgtcgcttgaagcgttgcaagcggtactggctgaaagacagcaacaacgtacccaaacggcgcagcaactgacacagttagctacggacattgccacggcgcaagcacaactccaagagttgacggcggatggccagtacgctacgctacgtcagcaacaggcggatctacaaacggaaatcacagtcatggcacgtcaatggctaacgcggcagttgggtgcgaactggatcgatacggcgctgcaggcattgacacaacagcaattaccaactgttttggccgcagcaaccacgattttcgcgcaattaacggcacagcggtataataagattgacttagacggtgatgaaatggttgtgaagacggcaacaacgcagttcatggtcgcggaactttcaacggcgactaaggaacagttgtacttggctttacggctagcgttgatcaatcatttgggccaagcagctcagctaccactaatgattgatgatggcttggtgaattttgatgagcaacgtaagcaagctgcttggcaagtcttagcagcagttgctcagcatcatcaagtgctctactttacgaatgagacagcggcactgacccaactgaagacagcgactgtacagcagttaacctaggggggataacatggcaaagaagttatttgattatcaattagatgaaaccgtggatggctattttttgttgaaagattcggaagttcgcatcgccaagaacggcaagaagtttttagccattaattttcaggatacttccggcgagatttccgggaagttttgggatgcaagcgatacagatgtcgaaaactttcaggcaggtcggatcgttcatttgaaaggtaaacgcgaaaactatcagggtaatccgcaaatcaaaattcaacaaatgcggctcactcatagtggcgaaccgcaagaagtgcaacaatttgtggaacacgcaccactaaagaccgacacgatggcggacgaaatcaatcagtttgtctttgaaattactgaacctaattggaatcgaattgttcgccacatgttaacgacatttcatgaccggttctttagctatcccgcggcgaagaaaaatcatcacgcgttcgccggtggcttagcctatcacacgttatcaattttgcgcttagctaaggcagttgccgatcagtatccccacgttaaccgggccttactatacgccggtgcgattttgcacgacatgggtaagacgattgaaatgtcggggccggtctcgacgacttatacgttggcagggaacttggtcggtcacattgtcctgatcgatgaacaaatcgtggagacttgtcaacagttgaaaattgacgagcagtcggaatctgttttagtcttgcggcatacgattcttgcgcaccatggtttgttagaatatgggtcacccgttcggccccatattatggaagctgaaatcttacatgacttggacgagttggacgcgtcgattcaaatgatgcagacttcacttggacatgcagagccgggcacgtatacggagcggatctttgctatggatggtcgtaacttttaccggccaactggtgatcaaacgaagggcgaattaccagacgaacaaaactaactaaatcgatacggtgtttgaaagaactgttgaaatcaatgattttaacagtttttttgtgacctttatttttgatgacgaattccattggggtgggtgagacggtgcaccattaattagcgtgggccgtcattaaagataaaataaaaattttaattgcaattaatatcctgacatgataagttactacgagtgattagttgttatcgttgaccattgcatacgtgttgaattagggcatgttgagcagtattggcgtgcacgatgcgcgtaatctagcggccagactgattgattaaacgataatccggcaactgtggcacgtgacgggaccgtcacagagacaaatgatttaaaattgcacgcattaggggagattatcgggatgaacgaacaagaagcatatgtaacgacattttattggctcgcggattgttggttggaaactagctatctgggacttgaggatgaatttgacgacgatgaaatcgatgacgccgtcaagtcactactaaatcggatgcaagccggggcaatttatgaggtaacggcggatgatccaatgtggcaagcatggaagcgggcagttagggccgtgcttacgcccaatgatcatgctgaacatgaagttgatgagaccgacggagaggatgaattagtgctgccagctggggtacgaccagaacgtcaattagaagaagttcaagcctatgcagcgatgaacgcgtttttgcaggcacaagatcaggaatatctgcaagaaattggtaaacgggcggccactcaggtcagtggtgccgggtggcaagtgtggcgtgcacatcgccagagcatgcatccggagtctgccgccccgctgacgttgactgctgagcaattaccagccgtgatgtgggcctttttcgataagtaccaggatactgaggactcttttgagatttttgaattggttagccaacttgaacaatggcaaaaaagtgctgatcgagatttggacgcgcaatggtcacagcttgtggcgaaaagtcagattgatccggccgcaattacgctcatgcagggcttgtcgttagctattgagttctttgatcagcttgagtgggacggtgatttgactgccaaggcaactttgcagaataaattgatgcaacgcacgctcgatgacacgctcaatgatgagacgacagccaactgggcggatgcctggcaacactgggatttagcagatccgttgacaactgaacagtgggcccgacggtttgatccggcggacgactatgaagaagatgaagacgagagtaaagaagatggctcggctcggccagcttggcaacttggtgcgagttatagtaccgttttgattgcaatgcgcttagtcgcttacggtgtactgcggcctgagagtgtgcctggtatggcaactgtgaagatggcgaaccgtgcactggcagctaccgtcagtattggtatcgtgttagttgcttggctggtcacagctattctgattacaattgtaatttggggatggcggtggctgcgtaagctgattttttagtgcagctgaacggccaactgaatcacaatagtgccgattgactaggctgaagtttgtgaatccagtagttgaagctgaaaggacggggcgtcagtggtagtgcttcatgatggtttgtaactcggacagaaagtcggcatctaaatggggcgattgtcctaattgtaatggtgccaatggctgatataacgttggtatgtctggctttaacggctggttattgaagtattgctgaccatggattttgacggtcgctttgagcgttccaatcgtcatgacggccacggcggtatttaaaaagacgccaccattgagactagtatatccagcggaagaacgcccaactaaagtaacgtgcgggttacgttttagcgccatgatggtcacctccgcggcactcgctgtctggttaccaataatggcataaatatgacgaaagtgggccgctgttggttgcgaaaagttaaagtcatcttgaccgagtccaccagtgattcggccatggtacatcatacgtggccggttgcgatgatggttcgtgatgccggtgtagagggtgccgtctggaatgatggcggccaggccagcaatcatcggtgccgaactaccaccagtatttgctgcgaagtttaagattaaatcggttgtcggcttagtttgtttaatcaggtgctggagttgtgtccaatactgtttttgtaattggtgctgactgctgtaaaatgctggcacattgatgatggtgaggccggcactcattgtcttggtcggacgggtggcatgttcgaattggcggagattggcgacggcgaatgaatgtaaatttgcagcgcgcagaatttgattgggttgggtcagtgacgtgattttgcgaccatgatcagtcgcatgtagcatggcttgccattgcgtgcgatggttgataatgccatattttgacatgtaggtgatagccggcatagcgttgaaggacgcacggagccgattagaagcggaaagaccaaacgttaggactatcgaaattagacctaccagtccgtaacggcatttattcgttatcatgataagccatccttacttttcgtgactagattagcatgtattggttagctaaagtgtaggcgtggcgtcaaaatttcgcaacgaaaagcatatcttaactggtgcgtctttgaaataatggttactgttaaaatacccatctacattggccgtcttaacggctaagcagatgggtatttgttgtatcatgaaattgttgacgattgtgccagatcggcttctaactgggttaagaagatcgtcaccaagtctttttccacctggttcagtgaatgctcggctggaaaggcaatgaaataattcagggacattaacgcttggggcaaaggtaagatgttatagcgttctggatcaggttgggtatgcacactgtctggtaaaaaggtaatacccagtccagcagtggctagtttggtgatggtggcggtattcgtgctctcaattacgatattcggtgtcacgttgtgcttttgtaataagtagtcaacttggcgtcgaatcgatgacccgtggggagacaagactagaggcgcttgtagcaggtcgttaagggggagcgctcccggattaatgaaggcctgatgtggttggtaccagttgacggtgttcgggataatcgcgtaataccagtcccgaccgcggtcataactttcaagccccggcgcgatggtttccggattttgaccaattaagaagtccagttcaccgtggagcacgcgctgttcgttgcgactagcgatatcttcggttaattcgatcttagtggccgggtgggctttcaaaaaagcaggtaaaaataggggcaataagtaatagccgaggctagataagacgcccagccgaattacttgctggttggcatgtgtgtattgcctaatttgcttattaaagtaatccttctcgttttcgagcgccgtcaaatattgataataagtccgcccagccgtggtcagtcgcagtggcgtgacttcacgattgatgatggtgacgcccaattctttttcaacattgcggatgctttgggtgaggtaaggttgtgaaatgtagagatctttagccgcccgggtaaaattgccgtgcttgagcaacacatctaaaaaccgtcgcatttcgctagaatctgattttggcataaagcgccttcctctcgcattgtgattaggtgagtattcgtttgattgctgatttggtcatgttgagttagttgcatcgccataaggacgttcaaaacatgttcaataagttctgtcaacatcctggcgatagtggctaaatagcattatgaccaaccattttaacatgattaattttaacgcgaatcgtcgacatagtaaatttgttatcggggtatagataaataaatatttcacaagcagagcgctttcacgtacactaatcagtattaagagtggccaatcattcaatagctactcgtcgaaaacgactgtttaaatcatcctgaaaggatctgaaattatgaaatttgttgggattgttgggacgaatgcaaccaaatcgaccaaccggcagttactgcaatatttgcaacggcattttcagcaacaagccacgattgaaatttgtgaaataaaagatttaccggcttttaatgaaccggaagaccgaacagcaccagtagcaattcaacagctcagtgataagatcaccgcagcagatggcgtgatctttgccacgccggagtatgatcattcaattccggccgtactaaaaagtgcaatcgaatggctgtcatataccacgcggccgttaattaataaaccagttatgattgttggggcctcgaacggctcactgggaacctcacgcgctcaagcgcacttacgccagattttagaggcgccggaattaaaagcactggtgatgccaaatattgaatacttactaggccgttcactacaagcttttgatgatcagggcgacctgacttatccggataaagttcaggaattagacaatgcgtttggcgaattcattgattttgtagatttaacgaataaaatcatgccgtcgagtcagtttttcgaaaagagtaagcagttctcgtggcggcaagtgactggggaggaataaacatgaaatttgttggaattgttggaacgaatgctcagcattcgtacaatcggatgttgctggaatttatgcaacgacattttgcgacacaagccgaaatcgaaattttagaattgactgatgtcccgatgtttgatgaatcgaatgatcaaactgacagtaccatcattcaaaactttgccactaaaattgcgacggctgacggggttatcattgcctcaccggaacacaatcattccgtgccttccgcgttgaaaagcattattgaatggttatcattcaaaattcacccattagatggtcaagcagtaatgattgttggggcttcatacagcgtccaaggatcgtcacgcgcgcaactacacctgcgccagattttagacgctcccggtgttaacgccagtgtcatgcccggttcagaattcttattaggtcgtgcccaaacggcttttgacgatcaaggtaatttaaaggtgcaagggacggttgattttctggacagttgttttgcaaagtttcagaagtttgcgaccatcgtcgccgagatgcgggcaccagaagcgcttagctttgccccgggtacttatcaggtgacggccactggacataatggcgaattgccaatgcgagtgaccctctccgctgaccggattgaaaatattgaaattgataccagtagtgaaacgcaggggattgccgatgtggcttttgaacgcattcccaaggagattattgcgggccaaacgctcgctgttgatgcgatttccggggcttcaattaccagtcatggtgttatcgatggggtcgctcgtgcggtcaaagaagctggtgccaatcctgatgatttgaagaaacggcgtgcgactaagcaggtcgctcaacctgctgtcaaagaagtgacgactgatgtcgtagtggttggtgctggtggggctggtatgacggcagcggccaaagtgttacaggctggtcatcaagccgttgtcctagaaaaattcccagctgtcggtggtaataccgttcgcgctggggggcccatgaatgcggctgatccggattggcaacgacagtttgcagctttgccaggtgaaaagcaaacgttgaaggatctgagtgagcgtgatgaaagtacaattgcacctgaatatcgggctgatttccgtaaattgaaacagcagattgacgcatacctgactgccaataccaatcaaaagggcaccttatttgattcaaccttgttacatcggattcaaacttatttaggtggtcaacggactgatttgaacggtcaagagattcacggtcagtatgatttggtaaaagaattgacggataacgccctggattcagtcaagtggttacaatcgattggtgtgaaatttgatgaaagccaagtgacaatgccagttggagccatctggcggcgcgggcataagccaatgggcgatctagggtttgcttacatcaagactttacgggcctttgttgaacaacagggtggtacgattatgacggaaacgccggtaaaagaattactggtgacggatgggcaagttcgtggcgtcattgcgactaatgcggctcatgagaaagttattgtccatgctgatgcggtgattttagcttctggtggtttcgcagcgaatactaaaatgttacaaaagtacaatacgtactggacggccatcgacgatgatgtcaagacgactaattcacccgcaatgactggtgatggaattcggctagggactagtgttggtgcagcattagttgggatgggcttctcacaaatgatgccggtatctgatccggagaccggcgaattattcagtgggctccaagtgccaccggcaaactttgtgatggtaaaccagcaaggaaaacggttcgtcaatgagtacggcagtcgtgatgagttaactcaggcggccattgataatgggagtctcttctatctaattgccgatgatgaaattaaaaagacggcttacaacacgacacaagctaaaattgaccagcaggtggcgaatgggaccttgttccgtgctgatactttgacagatttagcgcaccaaattggcatggacccggcagccctgaccaagacgattgcggactacaatcgttacgttgatgctggcgaggatcctgaatttcataagacggcctttgatttgaaagttgccgtggcaccattttacgcaacgccgcgtaaaccagcaacccaccacacgatggggggcttgaagattgatccggatgctcacgttttaaatacggacggtcagattatcgacgggctatacgcggcgggagaagtagccggtggaattcacgcgggtaaccggctgggtggtaactcgcttagtgatatctttacgttcggtcgaatcgcggcggctcatgctgttgctgagcacgttgatccggtgacggcctaaggcaattattaagtcgctacgttggttgagtcgtgttagtgtataatcgaccgtagagagaagcagatcgacaagggagattatcacatgcaaaaaccaatgccagtcgcggtgacgaacattgcggacaatattacgcaccaaccagcttatatgacgattgttttaaatgatcacaagtattcgaccgcgcgcaaaaagacgccgtttatcttgaaagcgttgaatgagggcgcggctgctcatgggcgtttgacgatcacgcctagtcggctgagtttggccgatgagcgcggcacagtctttcaaaccttggcgccaatacccacagtcatcacggacgtcgagctgggattgtatcgctcaatcgtgcggcaacttggtaatggcgtacgaatgaaggcccgttacacattggcggtgacgttgaccagcgataccgctacttatcagatgttaaataccgatttgtcagtgttgaaaccgctgttggcttggatcaccgactttcatcttcacttaaccgattcgttacaattggcaaccagtgacatcgactggcccaatttgacggctgatcaatttgaagcattgacaaagggcaccccgtactttgcttggcaacagacgattggggcccactggtaagtaaaattaagaactacaaaatatgaagccagactttcgataatagtcgaaagtctggcttcgttttttattataaaatttcaccgataaagtcgcctttaggtaattgttggaagtcgtaagtttcaaaatcactcacttgtttggtataccagtgtaagctttcggtaatcatcaggttgacggcctcatctttttcctgcaaggcgatgatgggcaagtcgcgcatggtagccacacctagctcgtaggcggtaccagaatctaagtttttggcttcaaagtctaagacagtcacgatgacttgcgcggccgcaatttgggccatgtcacggtggaaaatttcggtcgcccaagttttggtgaactgttcggcttgagcgtcctggtgtagacgtggtgaataaaaatccgtgaccgttggattttttgctaaagcttcctcaagttgtgtgacccgcgtcacttgttcgggactgaaaaacggactagcaatatagatttgcgccatgaagacactccttaaaattaatttgataataaagaccaatgggttcattttagagattttaggcgctaacgtcaaacagtttttaatggatggtctgagtggagacgtgtcatgtcaggttggtaaaaaatacggtgacgttggccattggaaggctaaataagtaacgtgggtagcgattgattaatcatcaacttgtttgtaaatctaccaatgacaacttattaataacactgatgaaaaagatgggcttattataaagtgatcgtagaactattggtaattccaatggatattctaagtatcaaagttggttgtgtttggcagagaatgggggcagttttatgcgaaataaattgttttcagtcctactaggtctgttaacagttttagtgacagtcatagtattaggacggattggacaagcggatgatgtgtcgacggctggcctaacggggaatgaggccagagtgactgatcggtatggcaatgtcatcacagatacaagtcaattaagcaaatgggaggattttacagtcgagtatgactgggctattcgcaatggtcaaccaattgcggccggtgatacagaattgccgaatgggacggttgcacccgttgatttggggtttccattgaaagacgataatggtcgagttgctggtcattttaaaattaaagcgggtgaaaccgctggactgattactttcaacgatgccttatcacaaatggggacgaatcgcgcgagtaccctccagttttacgtgaaaggcacggctgattctgatgtatattttgattggaagctatgatgagcatggcctgcctgcaactttaacatggaatattgcattcaatccaagcggtaagaagcttggaacagttgttgtcaatgacacattgggttccaatcaaagttacctctccgattcagtaattgcgcaaacgggcgcctacaacgatgccggtaattttgtgcagtcgggacgattgtgccacaaggaggctgtgacataactagcctctgtataagcaaatgggacgagaaaccgaattttggtttctcgtcccatttgcttacgcctttgatttttaaagttggtccctaccgtgaccagtttcataatgt

SEQ ID NO: 744 - DNA, 25738 bp, Unknown
  Metagenome-assembled genome
atgccgtagcaggcaacgttttaacgacctattaacttcaattgaagtaaaaagtgctaaacactttttctgaaccctttctttttattaataggcaacaaatgattctctttctcactatttcattaaaggagcgactcaattatgctagcttggctaccattccgcttttttcttttttttgtggaatcttttcattaaatgtttttgtttctacctattacgcttgtgcgcgatcaagcgcgcacaaatatccagcgttaaagcaaatcagtttaattgcctttatctgggcttaactcgatttttgctatacaccaccagttacaattttggttacccaatcggtatcatattgaaagggggaccgtgtaagcgaacgattgattcctttcccaacaaaacctgacagtgaatttggctaacgccacccccccttctcctcactgttcatgtgcccggcgggtactggcatggaaattttcccgacttgcccttggcgtcgtctttattgtggttggggatttattgacgggcgctaccacaccctcgagctgggaacaattatccttgaatggtggttaaccctcaaaacgttgggtgaattcgatgatgtcaacccaacgtttgaggtttaaccaaccagttaaaggatgaattgtccagctctgagtgtagccccgtaagaaatcccaaccaaataaacgacgccaaggcagcgggaggaaaattcctgccagtaaaccgccccccactggaacagtgtgaggagaaacgttgagccaaaaatcaagtcaagttgttggaaaggaatcacgttcagcttaaaagggtccccattgaataattggaattaacgagttgggtaccaaaattgtaaaactggtaggtgtatagacaaaaaagcagttcagacccacagagaaatgcaattaaactgaggttgctttaaaacgctggatattgtgctcgctgatcgcgcaacaagcgtttatagtagaacaataaccattaaggaaatcaaaagaatggtagccaagctagcataatgtagtcgctccttaattaaaatagtatagagaaagaagatggttggacctattactaaaaagaaattcagaaaaaaaagtttgacactttttacttcagtggtatattagtaaacgttgctgctacgggcggatgcatctaccacaaagaattatgaaattagttgttgaccacctttcttcagtaattgggaagcagtttctgttgtggtcgcaacggcaaccaaaatatgacaaattatcaaggttactcttaaaaagttgttgacaagatattgattaagatgtatgatgataagttgtgttaagcgattaaccacggaattagatctttgaaaactgaacaaagttcgacgaatcaaatgtagggtctcttgattttgaatcaagagcaaaacattgcgaagtcaatcgctagcaaataaattttagtacaacataaatgagcttttagaactcatattaatttgagagtgatctcgtcaggacgaacgctggcgggcgtgcctaatacatgcaagtcgaacgaactctggtagtgcttggtgcttgcatcatgattacatttgagtgagtggcgaactggtgagtaacacgtgggaaacctgcccagaagagggggaaacacctggaaacagatgctaataccgctaacaacttggacgccatggtccgagctgaaagatggcttcggctatcactttggatggtccgcggccgtatagctagatggtggggtaacggctcaccatggcaatgatacgtagccgactgagagggtaatcggccacatgggacggagacacggcccaaactcctacgggaggcagcagtagggaatcttccacaatggacgaaagtctgatggagcaacgccgcggagtgatgaagaagggtttcggctcgtaaaactctgttgttaaagaagaacatattgagagtaactgttcagggattgacggtatttaaccagaaagccacgctaactacgtgccagcgccgcggtaatacgtaggtggcaagcgtgtgtccggatttattgggcgataaagcgagcgcaggcggttttttaagtctgatgtgaaagccttcggctcaaccgagaagtgcatcggaaatgggaaattgacgtgcagatgagggacagtggaactcatgtgtagcggtgaaatgagtagatatatggagcacacagtggcgaaggcggctgtctggtctgtaactgacgctgaggctgaaagtatgggtagcaaacaggattgataccctggagtccatacgtaaacgatgaatgtaaggtgtggagggtttccgcccttcagtgctgcagcaacgcataagcattccgccggggagtacggccgcaaggctgaaactcaaaggaattgacgggggcccgcacaagcggttgagcatgtggttaattcgaagctacgcgaagaaccttaccagtcttgaaatatatgcaatctaagagattagaacgttccctcgggacatggatacaggggtgcatggttgtcgtcagctcgtgtcgtgagatgttgggttaagtcccgcaacgagcgcaacccttattatcagttgccagcattagttgggcaatctggtgagactgccggtgacaaccgaggaaggtggggatgacagtccaatcatcatgccccttatgaccgggctacacacgtgctacaatggatggtacaacgagttgcgaactcgcgagagtagctatctcttaaagccattctcagttcggattgtaggctgcaactccctacatgaagtcggaatcgctagtaatcgcggatcagcatgccgcggtgaatacgtttccgggccttgtacacacgcccgtcacaccatgagagtttgtaacacccaaagtacggtggggaaccttttgaaccagccgcctaaggtggacgatgattaggtgaagtcgtaacaggtagccgtaggagaaccgcggctggatcacctctttctaaggaatattacggaaacctacacacgcgtcgaaacttggttgttttgagagatttaactctcaaacctgttcttgaaaactagataatacaaatatatttttataatgaaacgagaacaccgcgttttttgagttttttattgaagttaatttcgctaaactcataatcgcatttaccattaggtaaatgaggttaagttaacaagggcgcatgtgaatgccttggcactaggagccgatgaaggacgggactaacaccgatatgcttcggggagatgtacgtaagctatgatcggagatttccgagggggcaacccagcagttttaattaactgttaccactcagatgaattcatagtctagttggaggtaaacgctgtgaactgaaacactcattagcagcaggaatataaagaaatttcgattcctaagtagcggcgagcgaacggggaacagcccaaaccaaagtgcttgcactttggggtgtgaggactgaacatttgagttaccaaagaacttgattgtcgagaaggatttgggaaaatccgccatagatggtgatagcccagtagattaaatcaaattctcagttcaggatcctgagtacggcggcaccgtgaattccgtcggatccgggaggaccatctcccaaggctaaaatatactcgtgacgatagtgaacctcatagttgccgttgcgacaacagaaactatcttaccaattactgaagaaattgtcaacaactaatttcaataattatttggtggtgagatgcatctgccgtagcagcaacgtttactaatataccaattgaagtaaaaagtgtcaacactttttctgaatttctttttattaatagtcaaaccagctttctttctctatactatttaattaaaggagcgactaaattatgctagcttggctaccattctttttgatttcattaatgtttattgttctactatacgcttgtgcgcgatcagcgcgcacaaatatccagcgttttaagcaactcagtttaattgcctttctctgggtcttaactgctttttgctatacacctaccagttacaattttggtacccaactcgttattcaatatattcaatggggacccgttaagctgaacgtgattcctttccaacaacttgacattgaattttggctcaacgttctcctcactgttccattgggcggtttactggcatggaattttcccgacttgccttggcgtcgttttatttggttgggatttcttacggggctaacactcgagctgggacaattcatccttgactggttggttaacctcaaacgttgggttgatatcgatgatgtcatcacaaattgggctggtgtcattatcggtgccgctggttataaaattgcacgtcatgttcccggacttcgctggttgcaaaaataacgtatatatagaagcaaaaagcaaaacaacgtttgtttagcacccacaagtgccaaacacttcagcgctctagctgttatgaaatcgtaattaaataagcgtcgcagccacttaaggttgcgacgcttatttaatttaactactaactattaatgaagctgccatcatcaggattcaaaaaacagatcgaatactcgcttacgatcttggttccagacttgattgtcactagttggataaactcgatttgttaacacaaccagcccaatttgacgatccaaatcaaaagcaactgccgggccagtaaaaccagtatggaaatattgatgtcgtcccgcacgtcgttcccaacctaacgtccggccattttcgtcatactcgcctaaccagtcaaagacattttcatccagcacccgtttgccttgatattcaccaaagtttaacatcatttcaataaatacggataaatccgtcagcgttgagaacaagcctgcgtgaccactctcaccattcaacaaaaaggctttataatcatgcacctgtccttgaatctgaccccgccgcggatcaaactccgtcggcacaaaccgaatcttcggacgatttaagttataacccgtattggtcatcgctagtggatagcaaacgtggtcttgaatactccgagccaatgagccgtcaaccgcacgaataatccatcccaataaaataaatcccaggtctgaatagacatacgttgtccctggcgccgtgacgagtggcgcatcataaaccgctttgatcagatcttcacgttgcatcttatccaggttatcaatatctgccggtaacccactattatgaagtaacaagtttttaatcgttatttcaggatgagtgaacccaggtaaaaaccgggcaaccgagtccgttaaatgaatcgtgtggtccgataacaactgaaaaatcctcgtcgtggtccctacaaccttagttaccgatgctaggtcataaatcatcgcaggatctaagcccacggcaaactcatcgcggccctgcttaccatgatagtattgattgatacctttaggggtgatcaagctaaacgacgccccataaatgtcgccagcttcaatacaactgtcaatatattgttcaattttttcgagcatccgcattacgcccacctttcactacattcactagtttctgcttatcttctttatgataacgaacttcctcataaaatcaacggcaaacgcttttaacaccctccacacctcgttgcactttttattaattaactagttaaacacttgttacattatggacaatattccacttatatatcaaaacaagtcttgtttttagccgttttctaaatataattaagtgaattaccaatgcctatctagctatgtaagtactgttatatcaacgttaatagtcaacttttcaataatagattgcaaaaaaataacccaaacgtgaaataaatcacctgaaagcggttacaaatccagcaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagaccgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatggaatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgtgaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacaccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaacatttaatctttaatagttaagaaggcgaaaggctcatggaaaacaaacaagtttcaacaacgcaagcggcggcaaaagagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacgcggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaagattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaaatcggcatttctagcatgactaaaacaccagcgttacaatcgtctacggatggttgtgtcactggtgtttttttgctggctcgacgcatgcacgtattgctggccggaattagtacagtggcacgcaaaaaaggcgccgcgagcaaaccagcaacgtctttccttaatcatgccctatccaatgaccgtcagcccttggactggctgcgaacaggccggccactaactatgaatgcctagttccattcgagcttcgcgggacatcatactttcgttccaagcaggttcccacacaatctcaatctcgatattgttaacttctggtaatttgatcagttcatcgtgaatgtccttagccaaccattcggtcaaaggacagcccgcaatggtcaacgtcatggtaatttcagcggttccttccgccgtcaattgtgcatcatagatcaaccctaagttaactagatcaattcctaattcagggtcaatgacatgtcctagcgcctcgaaggcccggtctttaaacgttgttgtcatcgtatctcgtccttccataccagcttgaattcactgattaatcacgccaacgtttcgcggtataagtgccaccacacttgatacacgtcatcgttatataaagcgctttcttgtctacttctattgtaccgtatgtcagcccatattcaatcaattattagcgctaattagccgacttttcaaacgatcggtcaatcagcaaatcatgcgactatttctcgaaaaaatttactataatccccgatatagcagcgttttgagtcactattgatttttattgcgaattcgcggttgtttttttgtaagcgtttgcggtttatgctattatactaagtgaggaaaggaattaatcctcgattagcaaagcttctcaaaagagtttggctgtcgctgtaatgttagacagctagtatcacagtttgggtcgttatcgaaaccgttttaagcgccgtgaagcgttatcggtctagcgagtgtcgtgagatttacgttggatgactgaacgttgacccttagataaacgataaccgcaaagaattaattggcattagaatgacgaacagattttaactaagttttagttggaaacaggtgtctccgatgaccagttgttagttccacattaccagttccatttgtagactcaggtattacaaagtttaaacggaggtgcatgtctgttacgaagacattcccaagttttaaacgcgagtttgactttcgttaaaacccgtctaacgagtcgcaatcaagtaacaaccttactttagatcgactatagcagatagttacaataaatacgggttagtccgttagaagttggacacgcgtaaaattgaatagcatgaaggtgtatcatattaacactgaacaatttttcattgctaatcaggattattcctcataagtagaactcaagcagagaagccttgggttctatttttttgctctaaaatcagatttaccaacagtcggcaccagacgtaaccgtttacatcctcttacgaaaaccgtatactgaatttaaatcaagttgcacattgaggaggactttagttttgaaaacgattaatttaggtcacagcaatattcaagcttccagcgtggcacttggcatcatgcgcatggacgctttggacgtcgcccaagccaccaaggttatcgataccgctgctgatttaggcatcaattacgttgattcagctgatatctacggtggtggtcaatcatcgaccatcttcggtcaagcactcaagcaggctcacgtatcgcgtgatcagctctatattcagtcaaaaggcggcattgttcctggcaagcgttacgacttttccaaacagcacatactggcagccgtggatggcgagcttcaacgcttaggtgttgattatctcgacaccttcctcctccatcgaccggacgccctgatggaacccgaagaagttgctgccgcttttgacaagttgcaaactagcggcaaggtgcgccactttggcgtctctaacttcaatcccatgcaagttgacatgcttcaagcggcactaaaccaacggctcatcatcaaccaactccaatttggtatcatgcataccggtgcgatcgactttggcttgcacacgaacatgcaggacgaacgtagtcttaaccacgacggcgagatgatcgaatactcacggctccataagatgacgattcaagcttggtcgccttatcaatacggtaacttcgcgggtatcttcttagacaatccgaagtttccagaacttaataatgccatgcaagcactcgccgatgagaaacaggtcactaaatcagctattgcgaccgcatggattctccggcacccagcccacttccaagtcatccttggtacgatgaatccggaacatctagctcaaaatgctgctggagcagacgttacgctttctcggcaagaatggtacgacatttactttgcagctggcaacgatttaccttaatcacgatcgacctaacagaattgacgattagtttttacaatcaaaacgacgaccccaaatcaggattgattttcaggtcgtcgttttttagacgtttcactaacatttttgatgtactcaccacatctacgcgtatacttaatcttaccaagactcaggaggcgagcgaatgacatccacttgcacgatctgtgaacgaatcaaactaattcaggcacatcagaatccttatttcgtttacgaactcacaacgggctacgtggtccttgctgatagccagtactttgaaggctacacgctctttttagccaaacatcacgttaccgaattacatcatttaccggcacacgagaagttacgataacttgaagagatgagtatcgtccaggaagcttgtgcgcaggcctttcatgcagacaaaatgaacattgaactactcgggaatggtgatgcgtatgttcattggcacttatttcctcgccataacggtgatacgcccaaccccggtcccgtctggtggacaccgctggaaacaatttatggtgatgatgtcagtctagacattccccgtttaagccggttgaagcgcacgctcagcgtagcaattgaggccacgcttaatgctcgggaagcagaattgcaggctttagaggcactcacaaggcctgctagccacagaattgacagcaattagaccaaatcaggacccagacccgcttagatcttggtggctacaccccaattcttaatcgcaatccgtcaccgtatttcaaattgccaaaatccacctatttatccggccgactatcatacgctcgcttagatttatagccagctcgaaaaaccgtcttcataacttcaatgtgccgttccttagttgcttgtgccttagttccaaaaataaagcgggcccattcgcgctgataaccaggtgtcaaagccacaaagaacgtttgcaattcagcatcaaccgctaacaattcggttaccgccggaatatttttttcaaatgaactgaggggtgctgtactcataatcaaacctccgattagttttacttaaatttactgtaagaaagggaaaatccctaattttcaggtttttatatttcgaattttcataaaattgcgctatcattatagtataagtattattatttgactactataattaaccatactgctattcaccaaggggagccctgctatgccaaaatttgatatcaccctcatcagtcccgaacgcgctaaagcgatgttgactgaatataaagaacaacgtaagaactctgtcccacatctggcccatcctggccgctatatcttgccggattacaaattaactcgtcgccgggccgcattcaaaattgttaaacatacctttttaacgccccactacaagtcttacgttgccatggactctgacaacggccacacactctggtttcataatttcggttccctaaccgaagctttattctggttagaaaccggccttaaaatcagcgataccgactcccattctaactacaaggaatggatggctaagcacactacggaaatcgaaaccttcaaagacttgctgcgcgagcagaagcataaacaagggcccaagactaagaaaaaagccaagtagcccgttttgacacctagattcagataagcagcagtacgctcattagcgtgctgctgcttttatttacgatcaactgtgccattcattactgactagaccaacctaaaagtggctatccaaaaacgactgcagcttgcgtgcaatcacgcgatgaccggcattgttcggatgcaaagtatccaccgaataaatggccgcttgagcgggaatcgcaaatgtcattcccgcatcacggtacaagctcaaatgtgggacgccatagtctgcagtcatctgggcaatcgctgcttcataatctgactgacgatacccgagaccattagtcaccgcactaaaactgcccccaaaatcagagccaatatgaattgctgaaataaataacttcggcacggtcggccaattcgtctgtaatcccgtcagtaacatcattaacgcgccataaaatgtcgtcatatcgcaatcaccgtattgccctaacggctgatcccgaccatagtcattgacgcccccaaagacagcaataaaatcagcatcttcaggaatagcttgatagcgcaccgccatcgcatcgtagcgactcccaatcgttgaaccagagattcccaaattatcgctccgctcgacatcccaatcagccgccaaaatatcatgataatgcaccgtcgccaacccattattcgccgtaatcgaatctcccaaccacgccggccgcttaaaactaacatgcccattactaatcgccatagccaatcctccctttactatcatcgctatcattctaatccatcccacctgaattatggtagaaagatgccttttagggttggttttctgttcgtcagccggtgagcgtcctattccgacctccggggctgggtgacaattgctggaacgcagccgacatcgatttgaactaacgcataacccgcgtcatctcaaatacgagtcttattctaagccggaaggaaatcacttccgactaagaataatttggctactgagcattgtcacccagcccctccagtctcaagccacgggttgaagccgagcattgtctagccaacggattaatgcggtttgggcatttgtccgttggcatagcaagcacagactttagtggcaccgaacacgtttcggtaagccgctcgaatggctgatgaacggccacttaactcggcacaattggtcgttggctattttgataccggaactttaaacgagacgttagggttaccctaaccactttgttgaggtgttctattattactatagtaattccgaaatagcgagctatcccaatatcttttcgacctaacagttgattaataaaattactgtttatggagaacaatgacaaattcatcaaaagttgggtatatcttcgtccaccattcgaatactgtcccgaatggaaggcgtttcggccaatgctcagcggtgaaattccacttagcaagcgtccttggcttggttagtagaagaccagtatttaagacgtggtcttcgacttaaatctgtgtccaccgcgttccagcaattggcagaaatgcctggagagcggcgtaggacgaacgaactaagcaggtttacgctaaccggaactgtttccagcgggcctaagctggtggctgttgactttaaataaaggcatctttctaccattatttcaaacaggtgggccaatcttaaaaggctcgtattatggaaatccataatacgagcctagtttaattgatatatttagttcaactgagtagcgctaatcggcttccgtttcacgtttccgtgcagtacgccgttcgcgtgcgtagtcagttttagttgtgatttcaacgtcacgtgctagccgtttccggcgtgctaattcagctgctttggcattggctttcgcagcttccttgactggatcagtcgttaagtcgtgatggatcgagtacagtaagacgagcgcgacaatcgttaatgggaagccagacatcgcacagatggactgaatcgattcaaagccaccgaccgtgacaagccccaatgagaagactaggaagataacgacccagctcatccgattgaaacgacttggttgttcccccgcggccaactttttactagtaaatgacgaggtaatgaaggcaaatgaagataccgtcgttgctaagaaaataaagcaagataggcagtacaaagccagcataatcatcttcaatggtaaggtcgacaatactgctgcaatcacagcggcttgtccttgcgtatttaagatatgaactaagttaacgatgcccatccgttgcaagtataaggcataaccacccaagatggcgtagaaactgacacaacctaatgagccccatagcaacataccaccgagtacctgacgaatcgtccggccccgagaaatccgggcaatgaataagcccatgactggcataaaggataaccaccagccccagtagaagatcgtctgccgttgcatggccgttgcgtgaccatttggtgcagtattcgtgctcaacgtaataaacttattgacaaacaagccaatactattagtttctgagtttaaaatatacaaagttgggccaacaattaaaacaacgattaagaagccaatcgctaaccaaacatgggcagcacttagtcgaccgatccccttcttcaagccattgaaaacagccatggcgaagattacgaataataaggcaaataaccctaactttaaagtcatcgtatcggcaatcccggtaacggcactcaaaacttttgaaatgacagggatttccatcccgactgaagtaccaacaccacccataatcccaataataacgagaaaatcaatcgtgttccgggcaatttgcttacccttaccaggaccttgtagtactgaaattgcggcactgagccgctgaaccttgatgtgtttaacatacattgcataggcaattgcaatcgtggctggcgcaaacatcatccacgccattggtccccaattaaattgtcccagcatgtgcgcataattatatgcagaagttgaaaacggcttgacgccgaatgaagggctttggaggtaccgtaacgggtcaaccatgctcaacattaaaatgctggcatcgatcccggtcgcgtaaaccatactgccccagtgatacgttgaaaattctggtttgtcatcaggatcaccaagtttggttttccctaacttactaaaccctaagtaaatgaaaaagataaaagtgatcacatataccgacatataaagccagctcatgttatttgtgagccagttcaagatgccacttaaactcgtctccagcgaatggccccccattaataaaacaacggaagccgccgcaaagagcccaattgttggtaaatagacccaccaatcaatattcttactttttaaaataataaacctgctactgagcatatactctctatatttagatcaaattcgtggttcttcctaccagcaatggtagtccccacgcgtaaatttccgactagcaatcggtacacccctccgagttaatcctcggagcactcagcaccctgactgtatcaggtttgaccggcattgtcatccgcattctgtttgtgctaactcaaaatcagtagcagaatttccttctttccgttggttgaatccggacaacgccatactgacaaatgatttttaattgcttaatcgacgttggtgttcatcttgtttagctagtgtttctattaccatcgtgcctttagcacacgaccgtcgtcacaccacgtaacgattaatggttacactgctcttgctaatagataacccccttgaatcaccagataagcccaccgcacaactgttagattaattgcttggtgcaccaaaaaagcgcttagtaccgggtaacaagttaccacctgcacagcgcacgttggcttatacaaatgctgatttcagtattttctgatatctgatgttcgtttataagtatactagtattaaatcagaagtaaaatcaaccattttgagccgtcgaggcctaacccgtcaaggattagacgagttttacacccatattttttctgaaactttttaaaagttttcgtaataattagtttttagtttagaataattcttatctgtttcaattaaaccgatttcatgttattcttgtaacaagttaaaaaacgttatcatctaaaaggaggggaactgcatgcggcactactataaattaattttaacggtcagcgtcggtatcattgcggttgttttacagtttggtttgcactaccaattggcagcacaaatcatcattacattaatggggtcacttatggccttatcaatgttagttgagatgatcaaaaccttacgttcaggtaagtacggggttgatttattagcaattacggcgattgtggcaacactagctgtcggcgaatattgggctagccttgtcgttctaattatgctcactgggggtgactcgttagaagattatgcggccaaacgagcgaataccgaattgaaagccttgctcgataattcaccacgtattgcccaccgctcagtcgccggccaattaacagatattgccgttgaagatgtccaaattggtgatcagctagtcgtcaaacctggtgagctagttccagtagacggtcaccttattcaaggaacggcactctttgatgaatcttcattgacgggtgaatctaaaccagtcgacaagcacgttggcgatgacattatgtctggtgcggtcaacggcgatagtgccgttacaatggttgttgataaattagccattgatagtcaataccaacagttagtcaaattggttaaagaatccgaatcacgaccagccaaattcgtacggctggccgatcgctatgcagtcccattcaccctggtagcatacgtcattgccggagtagcttgggcattcagcggggatccccaccgatttgcagaagtcctcgtagtggcttccccttgcccgctgattctcgccgcacccgttgcactcgtctcagggatgagccgaactagtcggaacggaatcgtggtcaagactgggaacatgttggagaagttatctacggctaagtccgccgcgtttgataagacggggaccattaccagtggtcaattaacagtcaaccaaattgttcctcagtctggttttactgccgaacaaatcttgcacctcgcagcgagcgctgaacaaaactcaagtcatatcctggcccgctcactcgtcaagtatgcgagtgccactagcctcagcccggcaacacaattagcagaagtaacgggtaatggggtcacggcaacgattgagcagcaacaggtcaaagtgggcaaacttaaattcgtcgcaccgactacaaccgccaagccacttgctaccactgctatctacgtcggcatcgatgaccagtacgcgggttacatcacgtttattgacaatgtccgccccgaagcagccgccacgcttaaagcactccacgctgagggcgttcaaaacgtcatgatgcttactggcgaccaacaggcaattgctgatcatattgccgccgatgtcggtatcgataccgttgctgccgacctcctacccgcagataagattgcccacttaaaggctgtaccagcggccgaacgccccgttatcatggttggtgatggtgttaatgacgcgccttccttggctgttgctgacgtcggcattgccatgggcgcccatggctcaactgctgctagtgaatcggccgacgtcgtcatcttaaaagacgatctcagtcgcgtggtcacggcggtgcgcattgctaaagataccatgcaagtggctaaacaagccgtttggattgggattgctatctgtacaatcttgatgttgattgccagcactggtatcattccggcactctttggcgctatgcttcaagaagttgttgatacggtctcaattctttgggcgctacgtgcattacgggatcggccacaatcatcagtctcatcaacaaccacaactcccataacaaaggatgtgagctaaccatgccagaatggctcttacgatgggcacaatcggcactgacttttgtcgttgttttaacgttcgtttcagtcgttttactcaacgtaccactaaaagaagcaattctcgttgattttgcttacatgctattaacgctcgccttcgattggtaccgcagtcggcaccatgcctcgcgctaattattcaatctaatagtcactaacgatggttttaccaatcattaatcaaaaaaatcgttcccagatgtcttcttgggaacgattttttagttaatgctcaatgcttcggtttagggtgagaccgaccactcgcattcaaagcctacttggccaacatataactaacttttacgtcgtccataatcgtggcaagtggtaccacatcatcaagcaaaattgaataccaatgtttcttattcatatgatagcccggtaaataatgttgtccatcaatcagcatagataagtcttctgggcgtgctcgcaaatctaataccgtcacaacatgtgttgcgcccggcaacgccagtttatcggaagttaccgtcaataatgcgccataccatttgtgcgtgtctgagcgtcgccaaaccgcgttttgtgggaatttaggccacaagaactcaagattgtcaccataaacagctttgacttgcgcaatcagcttacgctccggggtcgattggaagacgtcattatcgtaacaatgctgttcgatgttgtataaaacatcttgataggcctgcgctacttgacctacaaattgaccatggacttgggatgtcaggtgtaaaacatatacttcactagtcgtcgtatccgttaatatcgtgttcagactgccatcagtgttcaactcgattatcatttcaaattggccttgcataattaaagttcggaactgatactgaccattctgattgggttcaaatccaaactgactgagtttgctcatattgacccgtttattctcaaatctaactgttgccatctgctgcgcctccaacttcattcccacttatcctgaatgtgatgttcgactattgcaatccacaaacaagtcaacgcactcgttgtcgtttgatagccgctatatcattttataagtaatcacccgtaaagccaattcaattgaccattgctgtgttagtaagccgacctttcacaacaattaccattgttccaatcagccaatacttgcgctaaagctcagctaatcttgaaaaaacttcactaactcgtttttattgtttttttatacccgtccagccacaatctatggcacaatagttgataagtactggcaattgatgacctacttggttctttaaaccagcataacacaatcattttggctcgtggtattaacacatacatatcgttggttatgacctgaccctgtaccaaatatctttttggtcagcacagaaccatgtctgcgctgaccaatttactaaataataacggaggtcctaatttgaaaaaatatcgcgattatcgtaccgccattgcccgaacattgaccatgattcaacctaccgatgaaggcctcgcaaagggtgccaaagcgattcaggaaatcttaaacctggcgcttgatcctgataccatcgtagattcggataatacacgcatagctagactagccactagtaacgcacacaatgagaccagcggccacgctacgcaagcaaacgcggaagattcatcatcatccgtcaaaacaacttctgcacaatccaatgggcaaacaatcatgcaagtaaagcgcgatttaaagggttttgatttagtcgaccccaatgatccgaccgtcacaccacgctaccactacgatgaaattttggcccgacaactggtgattcaccacgatgatcaggtcctgttagaacaaaatttacggcaacatcgacaaccttatattgataaaatcgttagtcacgctactacagcggatccgattactgtcgcaccatttttcgttgttcattatcaagacaccgatgatacttatcacatcgaacaagattataacggcacaaccttatcgtcgctcaatccggcaatgaacgatgttacgttcactagtcaagaagcgcaatatcagcgcatcagtaatggtcaattagtcgacctggcttggtataaggagcggcctgagaaggtggttattcgttacgttcatcatagctcgagtcaaccgacctcgaataaagcagccaaaccagctaaaaaggctactatccacacaaccaccgtgccagtgacgctgcgcaccttagactttgatctgcacgaaaaaacagttgccatcgtcatgggcgacgttggtacgcgccgaacacagatcacgcaactcattgatgagcacaacgggcacaccttattgattgatgcttttaaacacagtaatagcaccaacttctattaccggcaaatcggtcaagcagacctcgtggtcatgattcagaatcagaataaacacgccacttccaaaacactgaataaagctgtcaagcattacggtattaaaatgacgattgctgatggcggcgggctgcagcagattgaacgagccgtttaccgcggaatcgctgatcttcccgcttatgagagtggcaatcccattagctacccccgcattaatgacgcttcacagtagcagccatttagcccattaaaaccacagtaaaagccccgcagcagctaactaaaacgtttagctattgcggggctttaaacatatttcggcacaagccttaaactacatcgttgttcagtagcagacacatcatagcctaatttcagtcaccgaacgattgtacttaaactgtttggcgctggttatcctgaatcgcaactggaataaagtcaaaggtcgcgtaatcgaataacccccgtgccgttaacttcaacgttggaatcacgggtaatgtcaaaaacgatagcgtaatgaacggatcaaagctaagtggccgctcgctaatgacctcatacgctcgtttaagttcggccaactgttcagcaactttttgatagctcgctgcagacagcaagcccccaatggcaagcggcatggtcgctagcacttgttcatcgtcaacgaccgcaattcccccgttatcttgggtaatctgggctaccgcccgtaaaattgcagcatccgacgttccgaccgcaacaatattatgagcatcatgcgccaccgtaccagcgatagctccctgtttaagtgcgaagccatgaactaagccgacgcccaccttgcccgtgttatgatggcgctcgatgacaaccattttgagaatatcacgttggcaatccgcttcaaaattctgcgttgcatcaatcgggagtgttaagtgatccgtctcgatatggttcggctgcacaccaattacatttgccaacccggtcgctagtggtaattggaagtcggctagttgtgcatggtgctgaacacgcgttgcagtaaacggcaatggttttgtcgtgcttggtaatatccactgtccccgcttcatcgtccgcgcaatcctaacgtgttcgagatcatctaagaccactaaatctgccaactgcccggctgacagactgcctcgatcacttaaacgatgcgccatcgcgccgttgagactagccaatgtgtaggcaagttcaggacgcatcccgctctgcatcgctaggcgcacgttataatcaatcgacccttctgtgagcaagtcactaatcgtcttatcatccgtacaaaaagcaaaccggctagcattagcttcggtcactgcaccaatcgtcggcaaaacatcgcgttcaaccgtcccttcacgcaagaaaacagccataccagcccgcacacgatcctgtgcttccgccactgtcatacattcatgatcagtatccagtcccgcattgcgcatcacattgagctggtgcgcattcaaaccggcagcgtgaccatccgcatgatagccatacgcataggcatcactaattttagccagggtgtcagtatcaccacgcgcaacggccccatagtccattacttccgccagtccccgaacctccgactgttggtaaagtgggcgcaagtcagcagcatgtagcgttgccccgttatcatcaaagggaacacacggtaccgatgacggtagcataaaacagacatctagtggtgtttggcgcgcatcatcaattaggtactgaatgccagcaatacccgcaacattggcaagttcatgtggatcagtcgcaattgtcgtgacgccgtgctgtagtaagacttttcccaactcgctaggtgccaccatcgaactctccatatgcacatgtgcatcgatcatgccgggaacgatccactgaccggtcgcatcgacatgctgggccgctatgtacggctcgtcacgcaagttactaataatccggccgtgatcgatccacaaactggtggcttcaaattcacgggtataaacgtttaacacttgtgcaccagtaatcaccatttcaactgtcttcgtcatcgttattttctcctcactagtcagtctgcctacggagaaagcaaacgggtccacacggcaaattaagcagtgtagacccgtcgactcaattcgcttatagtccagtgtttacggcactgggtagaaactcgccatccatatcatggcattatataggcaattagttgtattgataaattgttccttactttaccagccttttcagttacatgcaagccctaattatcataaatgattggtacaatgaacttagaactagacatgaatattcacctaaatcaatgtcgggtctgccacaaacagcgctggcattttaaatgaacggcatacgatttgcgacaaggtcccttactggtgacgccatctaaccagaatgctgattaggatgttgttctgcgtacattgaaacgcaacatgttccgataatggcaagcccgtgaataaaactgttggccgttaagtcgtcttttatgatgatttgcgagcagtcgcctttgatttaaagcggacccgctacgattaatcaacagtcatatttttaaacattcttttgctgactgtaagttcatttacgtttacaataaagctaaattaatatacataactatttttttaggagctgatgattttgatgatgatgaataatccgaccatgctctcatacattcgtcgggaacagccagtactagagcggttgttaaccaattatcccaaacagattacggcggccttgactgccacccctgatcatccacaacactggttgatcctcgcaactggttcaagactcaacgccgccaacaccgcccgcttatacatgcaaaagacggccgccctccaagtgaccattgctgcggccgacctctacgtcacttatgaggaagctgatcccagtgtcgatgttgttatcgggatttctctaaaagatgatgatccaaccatgcaagcggcaatcgaaaaagcccacacgaccagtcaagctcatgtcattatcgtgactaatcaaaaatcgactgctctgaccgcaatggccgatgcaacttgtgacttactaactggcaaagaatcagtgccctatattacactaagctttcaagccatcgtgctcactttaatgttgcttgccgtccgcagtgctgcccttcaagcacggttaaccgaattagcaatcaatcaagaattagacgagttcagttttctgattgaaagcatgaatccaactgttcaacgggcgaacgacttctaccgtaagttcactattgatttcactaacgcccctcaatttacagctatcggtgctaacgtcctagctggaacactaactgaaatgcaagccaaattcaccgaaatcctccgggtaccaacgcatggttactcattagcctcatttacccacggtggctttatggggacgcatgaagatcactgtcagttctatcttgaaatcaatacagatccagctgtcatgacccaattacaggccgtcaagacgtacgaatcgcgattaacgccccacatttataccatcagtctcactggtgaccagccgaccatcaatgatgatcaaaccctccagctcgaagccgttgctgatccgtataaagccccactacttgcgattatcccgttccaagtcttagcttggttcattgccaaatcacgcgggatcaatttgaaccatcccatgtacgcagattttcaagcggctactaaactcaagtaaagattactaaatcaacgcaaaatgaggctgtgacataagtctctagaaacaaagcaggtctggaaaaatcttcggatttttccagacctgcttttgatataatagaaaataaaaaaagagcatcggtcgcacccgatactctacgaaatt

SEQ ID NO: 745 - DNA, 22584 bp, Unknown
  Metagenome-assembled genome
ctggttaatttggagtaacgtcgtcgttaaatcttgagcactaatgtgctcaaaacgagtccctttaggataaaaataacgtaaattccgattaaagcgttcattactacccacatcgtgatcgctggtattcggcatctgtttgtgctaattcagcctgataaggttgacatcgagataattcataagaaattgttgacggtgatcggttcaaccgaacgcccatttggatattggacagccctagttcacaaaaggtttcgattttaattcgttcggaataggttatactagacaggttctaaacaccattttaaaggaagctgatcttttttgtccgaacagcgttcggattaattttacaatctacctatctgttcaagctcgatgtgaaagcaaccgatgtctatttacgcggcgaatttggtcaaaaaagctctcaaacccttgctacgagcggaagttcaaaaaatggacttaatctatatagagaacctaaagaaagagacaaaaacagatacaatatagatactcaaaagttgaacttttccacagcatgtttctcaccagatgaaatcgaaaagcaaaaccatgatctcataaatcatgctaatgacttcttaactgatgaagacagtgggctccccgttttcttagaacccgaagccgtgcaattacttagcctctggtgccgaactccacaacaaatgcgccggttcattggcattatcttaaatgctaagtaccgagttgagaaggatcatcaggacattggcgttctaatcccactagacgatgaagaactaaaatctttgatgactaaagccttgagacgctactttaacgccctaagaagcaatgaaaagcatatcaagaacgtggaaaactacttgtacggcaccatgcaaaacctatttggcgtttggtggaataaacaagcggctagagaatatgcggccaaacaccccgaagaacagaacactgacaatgagcgttcttgaaattaaacgtcatatggactcatttaagccgttttaagtgttacatgcataatcatattaaaactgctttaaaatcgcttagaagtaaaaataggtgccttaagtggccgaattgacgatagctgagctagaaaacgggataggagctttttaaatgaccaaacccagcaaagaaatcgaaacaattgatcaattgttggctgacccctgggcagtcaatattcaagacatttgggaacaagcggcatataatccagatcctgataaacgcaagctgtttgacgcgttacatacttacctcttagataaacgtcaagagaagattatcaacgaaaagcatttcgtgatttaacatgagtgagctaaagagatacatcatcgttgcggggataaacggcgctggtaaaagcactttatatcgcgcgagacccgaattatttactcactccaaacgattaaatgccgatgaaatcctacaaaaaatgggtggcgattggcataaagatcgtgataactttagggcaatgcgagaagaaataaaacaattccagcggctttagatatcgggcggagtatccatgttgaaacaaccttgtctgggcaaggaaaggcacaattaaatttaatcgatcgggctcaccaaaatgttttgaagtaacacttttatatgtggctttaaaaaacgaaaaagttgcaattaatcgggttcatgagcgggtcaaaaagggtgggcacggtgtatcagatgaagttgttaaaaagcgatataatcaatcaaatcaaaatttagcagcagttgcattcaaagctgataatgtcgtgatctacgataatagccaaaaatttgtgtgagtttacagacgagaacacgaccaggtgatcaaaaataatttgcataactttccttggataaatcccaaaatcacctttgagtcagctatacagaaacaactaaatgactttgttaaaaataatccagatttaaaaattagaaatcccattaatgattcagaaaataaaaacgatcgggctagttattaggctgatcgtttttgaatttatccggtttatgggtgttaacatagtcagcaaatgtttttaaaagttctttggtttgttcgaccgagaggttattagcttgaaagtacttttctaataaagcccctttttgaattaatcggcgagaacgggctttgcgggcttgccgattttcatagtatttagattgccgtaattttaaacgcgcttgctgctcgactagtttttcatattgattagacatggaatttccccatctcgtatggctaatgatctacggactttacctttaaaaattcagaaaattgcttggctaaaagcacgatccctccaatcatattagaaataatcaccgaaactatatcatataggaaacgttaagtcaaagtataaaatttgaaatagcgaagcggaaggcatacactaaattaaagttaagagaatcagaagaccaagtgaaacgaggtcaatggaccaagtgaaacgaggtcaatgcgcacttacacgtcatctttgatgacgttgtgctaagcccattaaaacccgtattagaagtcgccgatgtcgacaacaaagtcaaacccataaacccaaagaaaggtggtgaccgacatggcaatatttcatatgagttttagtaatattagtgctggtaaaggacgcagtgccattgccagcgccgcttatagaagtggtgaaaagctatttgatgataaggaaggtcgccactatttttatgcccgatcgatcatgccagaaagctttattttgacgccaaaaaattcacctgaatgggcgagtgatcgagagcagttcgtcgagaaaaattatgaatgaagttgaaaagaaagatcgtaatcaaactccggtaagcaaagagtttaacgtgtctacaccgtagaataaggaatctgacagaaagaattatatgacaaaagttgcaagaaaatttgtctgatcaggatggtagccgacgttgcaattcatcgcgatccacccagactaatccgcatgcatcatgcatgtttaactaatcggccgtttaattcagatgggaacatggaggaattaaagaggcaaaagcaatatattttagatgagaatggcaacaaacatatacgggaactatcacgcgagtcaattggcatggagttgttgtgtggtgcgaggtttgtgaaaagggtgcggaggtgagagggaggaacgttttggacagtttattggaagtggtattgtgctacgtggggacggtgggttgagtcgttttgggtcgaagcgaagggggatcgtggggatgtaagtggaagactgtgtgggctggcggatggggggagcggttgatgtgggggggttagggttgatgtgagggggtagttaggcgatgagtgagtggggaaggggttgagggggggggcttataaagagtttcggtgtgtggggagtttgtggtggtgggggtgggggctattgttggatccaagagtaagggttggagatgggggtgggggtgctaagggggtcttatgctgtgggtgggcgtgtgtgatggttgagtggggtaggtttgtggtaagggactgttgaggtgatagtagctggttgtgaggggtttggtgtttttagttttataggcgttgtgggtgttggttaggcgtgagtgggtgggttagttttttacttttgagtgtatgggggggtgggtttatgaggtgggaagttgcgggttgtggggagtggtttgcattgaggtaggttttgcttatgcgggtggttttgttgttggtgtggggggttaggttctggggtttgagggtatgtggcaatggtcgggctgtgtaagtgggaggcggtgggggaggggtggggggtgggggtatctgtttggagggcataatgcgggatggtagtctattgtcgaggtggttcatatttgtggctattcgttatgtgaggggttgggttaggagtgggtttttgggggtgcagtggtggttgttgttttttgggaagtcaggtgaggggttaggggggagttggtatggtgttgggatgtgtcgagttgatcagaggtggatgggtgtatgggtttgtggggggtggttgtatgttgtgggggtggatggggttgggatcggttggggggatttgttgtttagatagtggggagtgtggggagtagggagcagtatatgatcttgttttgtggttgttgcggtgatgggagggatatagggggagtatgcgtttgggttcggtgttgggggatgtggtggtgggtacttagttgttgagaacgttgtttttggtgtggatgggtggtggtgtttggtgttttaggtatcggagtattgggggtttgtggtagggctggtgtttggttgtggtggtgtatgcagtaagagaggatatcgtttgtgttaaggtggggtttagcgtttgggggcgctatgggggggtgggccgggagcggttggttgggtggggatagggtttggtgcctaattaggtgtatttatgttatgttgcggaggttttgggtggggtctcggtctgtgagggtgagggtggggttggttttgggtgtggtgggggcggagtgggttgtgtgtgttgtagtaagggtgggatgctggcgtgtaaggatcttaaggggggttggggaggggttgttgggagttgggggatggggggacgttaggaggtggtggcggtgtgaggggggggtgtcgctcgtgttggatgtaaggtgggttgggggtctggttttttatgtatggtaggaagggggtggctgagggtttggcaacgttgcggttgggtggtgtgtggattcgtggtggaagggtgtggttggttgattgtaattgtgttttgtctggtatggggacggattgtgttgagttggatttttgaggggtgggttcggtggtggctggggggtgtgttggggtttgagtggggcaggtttggtattagtgatttttgtggagttgctgtggtttggggggcgagtggttgtttgggttgtatgaagtttcaggagggcgtgtgggatcgtggtgtgggtgcgatggatggtagcgttaggctttgagtagagggtttatcggagggggtgtggtgggtgggttcgtaggtgggtgtcgggagtgtgggggaggaattttgagttgttattcagggttggggggggttgcggggtgcgagctgaggtggtggggcgggtttgtcggggcacaaggtttggtgggtgtgaatggctggggtatgtgcggcgataggttggtgagatggggtggcgatggtggtaacggagtgcggggtgtgggagattgcggacggtaagggggggtgggcattggacgcgaggtgggatagtggggacttctgttggggaagttggtggtgagtacgcagtgtctaaagtgttcggggggtggatgatgagggggagatgggggtatgcggtgtgaatgtgggtatgggtttggagtatttgtgggctttgggggggaggaggtgggtgggtggggtgggagtgagggtatagaggagtgtgggtggtttggggtttggaagggatgttgtgatagtggtggttgtgggttggtaagtttcacgtggtagtatgtgtggttggagtatgggatagggggtgggggggtgttgaaggcgggtgtttcgggtgaggttggagaaggttgcgggtgagggtgtttgtttgggttctgattgatgggtaccgtgacggggaggtttgggttgttttagaagggtggttcggttctgttagggtgaggagtttcgtgtgggtgagttgattggtggagtttttgggcggtgttgtgtggggtatggcggtggggggtgatttccgcacagtgtgcttgtggtaccgggtttcgagtattaggggggggtctttagtgggtgtcttgtcggtgttttgagttttgggtcggttggtgaggatatgtggtcaattgggggtagggggtgcgaagttgtactatggagagaggagttgtgttgggggggtctgggtttggggttttgaagagtgggatgtggggggggggtggtggtggtgttttctttgtgggggtgttggtttttgtaggggcggtgagggggggatcggctgtatgtgggggtggtggttgtgggaggtttgggtgtggtagtggaacagagttgtggtaggtttgaggatgctgaatcgttagaggctcggggcgtgaggtgggtgggggcgtgtgtagggttgggtggtgggcgattttgtggagggaggggatttgtgcttggtatgagtggtatcggtatgctgtagttttggtttggatgggttttaggagtatgtgtgagtttacttggtgggttggggggtttcgttggggtggtgttgggtgtgttggggtgacaatgggtaggggtcgtgacgtgttgagttaaccgctaagatagaaagatactgatggtttcgattgggattaaaaaaaaaaaataactgaatggcggcacaattgggcaacagtgtatcagttttagcacaaaaaaatatccgatcggatagtgaaaaaatatttgtggaacagggaatagtgatacaccaatgcaacatgagggaatcaatagcaaacggcatgaagaaaaggctttaacacaagttaagaactatcgtaagtcaaagctggctataaaaatatgcagagaaatagttaatcgaggccacttggatagcctaagtaaacacttctcgtttaacgagaaaaaagtggtcaaagatttaagccacgaactgaaaacttatttagtttggaaagtttagatgataagggcgcatgctatttaattggaaaaacagtaccttaattaagcacgctgttggtgaagatgtcactaagcaattattgacgattaaccaacaagaaagttcactaaaaaaagcagagaactcttaaataagtagttgatcgcacactaaaaaactttatccaagcttgatttgaacagacaaccgcggctgaacgacgggaattgattaaagaaactaatagtgaacaaacgattttcaaaggcagtgaattaaacgaacgtttaatgaatattcgtgatgatttttgacccgacaattattgacctttaccaacggcctacgttgggctgaagttattatgcaacaagaaaaggaagtcaaaatcagcttaaatatacgctgatgattcatgatgatagcttagaaagtctagaacacgtgatcaaggtctactagaagtattcaccaaccagcagcaaaagattactcgagcagtcaaagacctacgggcaatcatggccgttaagcaagtcattaaaacgcaataccatgaattttgaaaggcctttcccaaaggcgatttagatggattgccattgattaacagaacaagcctatacagccgtgatgtactatgatcctgttttaaagccatgtcaggctgaaacaattgaacagtggcaagcaaatccaccacaggtgttcagtccccaaaacatcaacaaggactagcttatttatcgccagcttagcttagatcagttagaaaatcatcacttacaacggttttaaagcatgatggcactaaacaactctttttggcaagtgcaaagccgatccgacgattaagaacagtcagatcggaaaatccaaaagcagttaaaaggcaacaagccaaggacgaccagtacagaaaagaaatatcggacattatcaaaccgctaaattacaagccatttagtccagactattacttaaagacggcctttagtgacgcgatcatgactgttctatatgctctgtgatgatatccaacgacaagacaggcgcaaggttgtaaaggaagactggagtggaaatgacgaaaaagcaacggcaaccatcaactcgaaaccggcatgaagatgggcatgcacttgtaatcacaaaatatagcgactggttaattggtatgaatggtagcccataatgtttattcttattgagaaaattgagtagagcgtgctcgattagttacgtcagacgccaatttgtatatggttatcaaagaggaccaggcaatcaaaaactttaagccagaaccttattttgaactaaatggaaattttctaatcagcaaaatttgtcgcaaaattagacccctatcagcgtttaaagacgaaacagggctaatgacattcagcaacctaaaccgcttcagaaggctcacaggcggtttaatcaaggacgtccaaaacaagcaaaaaacgagctgtccacaactatgctcaaattccaaagtgctcattataaattcgtcataagtcgacgagctcagcccaactgtacggctttcgaagagtggatttgaggcacgactgctggtggtgtttttttttgggttttcaagtgtttagccatttgcaacgaggtcaacttggattcggagtcggtatctagtctccaagtgccatgaataaacgttatcacgccagcgccaccaaaccttagcggcattcaaagttatagaaacaagctcgattatccccgcaccgattgtgcttatatcactgatgaagaatttgattatttagtggctaatctgacgaatatctggggttgtctctaacaagtcgctttaaccaataccccccaataagcctatgttatggaaaaaggttgaagaacactacgcattatcatgactaaagtcgtccgacgaaagaaaactgccttcctaaattacagcatacatactataacttgtttttttaagaacgacgttagcgatgtttgctgatccgtacgagtacgaagaaaccaccattatcacccaggttggcgacgccaattttaaagcaaccggtaaggtcccaactaagcaaggctggcaagctttatttgatgaaaccaaaaccgagcagcaagaagtagcaactttaccgctcgttcaccaaggtgatcaagtccaagcaaatctgcaaacgccgcaaaaagaaacgacaccaccggtaccttttaccgaaggaaccctgattacggccatgaagactgctggcaaaacgcttgatgatgaagctgcccaggcaattctcaaagatgtgcaaggcattgggacaagtgcgacccgggccaatgtgctagaagtgttaaagcaacgcggctatctcgtcactgaaaaaaataagctgcacgtcagtgaagctgggatcacactatgtaaagcggtcgaactcgaacccttgctaactagtccagaaatgacggctaaatgggagcaagcgttacagcaaatcagtaccgaagaacgcaccccggataactttttgagccaaattaagaagttcgtagtgaaattgatcgctgatgtcccaacacaattaactggcagtgcagccattaagcaacaaatcaatcaccaacagcaagcgcaaaaagttgccgaggtgttcttagaaacaccacaagtaactgtcataaataaacaaaagttttacattgtgaaacccaagcaaggcgaggactttaccctacccaagaaatggagtagcaagacgcttggtaagaccgcaattaaagcgctggtcaccaagggggaaaccagcaaattaaagggtttcaagagcaaaaaaggaaagtcgtttgctgccaagttaaagcttgacggccataaattaagttttgattttgattagaacctgcctaccgtcctacactacgttccggttggttaacccgtcatttaggtctcacttcatatacaggtagatcaagccttttttattttaaattattccaagctttttgccgtatgcttcttctaaagcttctagacttttagctatttctttaatcagagttgatgctttgtagtgataggaaactgctatgtcaaagtttagtagggtagtaggtatttctactaagttaaatggcttcttgccaatccatttttctgcaaaatcataacttgtgacaaaaataccagctccttgagccgcagcgttagtacctacaacatggttatctacttttaagacttttccttgattaacattgttatcaatcaacatatgatcaactaatttttgaaagaatgaatcgtcagtcaaagatacaaagttttgattattaaacttggttaaatctcttttagttaagattcgcatgtagtttgtttttgaatatagggatgatgtagctggaattagaaaatagaacctattagtgaatgtcttattgctaacaatcttatcattatttaaattctttccagcaaataaatctatttcccttgttaacagtttttgttccgccaaatcggtagtgacttcagttaattcgaagttaatagaggggaactttttgtgaagatatttgtaaataatatcgccataaagagtagtccacggctgattagtagcaattttaatgtagcttgctgaattatctctgaaaggagcaagatctattagtagctgattctgtagttctagctgtttctctaaactttcaagaataacctcgccagctctggtgagtttgattggtaaaggctttcgatgcagtagtttagtgtgatattttacctctgcttggtggatttccttactaacatacggttggctgagataaagtcgatttgcaatgtcggttattgaacgacaagacttactaattgataggatttggtatattaattgttctcgagccattatttctcctaactataactcttttggaataataaatgtgtattttgataatgtacagtagccttttttattgcaataatatcatttgtaatcggtttattataaatcatatcactttgattatagtttggaggataattatgtccagattaaataaagataatgtaaactttgacaaaaactatgatgttatagttttaggctttggtggtgcaggtgctacagctgctcgttttgctgcagatgaaggtgccaaagtattattagttgatagcgctcctgaaggttatgaaggtggtaacactcgttacgcagcacaaatgatttctactaccgaagattatgggtcagaaaagaaatattttgcagccttaactaagcctatgtacgctgatcaagaggtcgcagatacctttgttgaagggatggccaacatgtctacttacttacaaaagtatttaaatgttgaacatccttattcatataagaatgacttcttaaataatcctaagtttggtccatttcataaggccttggttgataataccgttgaatataaggaattacctggtagcgaaaaacatgatgtattaggtgttaccttaggcttctttgatgctggtctatggaaactcttaagaaaagaagtcttgaagagagacaatattgatgtttggtattcttcaccagctaagcatttaattatggacaacgataataacgttgttggtgttcaaatcgaacatgaacatgtgttaagaaatattactgcaaacaatggtgtagttcttgctactggtggttttgaaaataatcaagaaatgattgaagattacttaggtgcttctaaactttccccattaggcagcctctacaataaaggtattggtattaaacttggtgcagaagctggcgctcaaatgtggcatatgaataactttgaatcattaggaatgttacatggtatggcattcaagactgaaccaggcacacaaggcagattaatcctagccgactggaaagctcttaatgaaggaagtgtattccttgctggggatgacggttcacgttattacccagaagatgagactaaccgtcacggtcatatttacagccacggatattggaaagtacctcaaaatcaagatcatccacatattatttttgaccaaaagcaatatgaaaagtttgctgaaaaagaggggaatctagctccaaatatcttagaaaaagtaattaaagcagatacattagaagaattagctgaaaagattgatgctaaggttgatgtcttgaaagaaactgttgctgactttaataaatttgctgaagataagcatgactatgcataccaccgtaatggagaaagcttaactgcatttgatgaacagggtccatactatgctttagctgttcaacaaaccgttcttaacactcaaggtggaccgagaagaaactcaagagctgaaatattagattcagataatcaaccaattggtcacttatacagtgcaggtgaattaggcggtgtatctgccggtcgttatcaagctggagagaacttagctgaatgtttaatctttggtaagattgccggacaaaatgctgcaattcctaaacaaaagatctcaggtttagaatcttataaatgcaaagaaactaaaccagatgctgaatctggtgcatcagaacatgaagaaaagactccagaatttactgctggtaaaaaccaatacattggaaccagtgatgaaggaatgggcgataccatgaccgttcgtgttactgttgatgataataaaaacatcaaaaatgttgaagttttaaaacaaagcgaatcaggtattggtgcagatgctattaagacaatacctaaagaaatggttgaaaagaacacatatgatgttgatgctgtttcaggtgcatcagctactaatcgtgcattgaaagatgctgttaagaaagctatagaaaaggctaactaattaacggtttcagacaaaagaaaagcactcgaaaaaatttcgagtgcttttttgctgtgtctatttaatttaaatgtatttatctaagacaattgcaatactaaagattatcacgtgcccttatattaccatatttttataggaaatttctcactaacttcaccaaccgtcaatagtgatatcactagtgttagcgtagttatcaaatatatgttcccgatgacataacaaaggcgctgtatcgacagtgaaaaagccggcacagcgccttttgttatattcaaactctggtctcctctataggatttctcattttcatattcatacctatctaacagtacgaactaccaagagaacatattatctaaaatagtattatctatacttcataaaacggccactagggtataccctagtggccttttttgcttctgtgctatactaggcattaaaagtgttcattaggactgtccaaaaggagaactggaaatggctaaaattggttatgcgcgtgtgagttccaaggagcaacatttagatcgacaattagcggctttaagaggcgttgataaattatttacggataaattaagtggggctaacactaatcggccagaactgcaaaaaatgttggcctatattcgtgagggtgatattgtcctggtcactgaattagatcgcttaggcagaaataaccaggacttaactaagattatgaacaccattcagaacaaaggtgccaccctagatgtgttgaatttgccgtccatgacggggattgcggatcctaacttgcgtcaactgatgactaacttaatcattgaactgtataagtatcaggccgaaagtgaacggaagcggattattgagcgtcaacaacaggggatttttctggccaaacagcaggggaaatatcatgggcgcaaaccccaatataccgaagatgatccccgcttactacatgcttttaagctttatcagacgggcatgagtgatgtagacgtcgcccgtaataccggtattaagcgaacaacttttatcagatatcgcaagaagtgcaatataaaaagatgagatttacatgcgacatgcgataatacgtgatactagtttagaagaggcgcataatagatatcaaacaatggacttactaaaacttatcaaatcaaagtggtggttgaccatatggatttagcatcaaagaagaagcttaaactgcttctactaggacccatggcgctggtaaaacacactaatatcgatgcgccaaagtctcttaaatccaaccagtgggcatgatcaagatgaaaccaacataaagtagcatttggtattccaacaggtattgtagataatgattgaacccccccccccccccccccccccacccctagttatggagaaatttgatataggaaataaactttaataaagaaagccaaatcgaatcatattgatgcttgattcagaaaatcgggttcaactgatttattaatcaaaaatacggccgactttctgggggaccggcgcgattgactatagcaagagctttcctactaatcaacctgagatatattttttttggatgagccaacacgtggtttggatatccaaacacgctcggcaatttggaaatgtttgcttcattgcaaagtcaaaataatttaaacccttattttgaccgaccaatcttgaagaagcgacaatgcagatgaggtttatattattgatcatggcaaaaataattgccagcggatccgctgatgaaagtaaaacacaaactctagcaaaactctgtgattgtttctgaacagcctgatcaattaatgcatatggggatacaagtaaataattctacgcagattaactaaaaccatttgtttaaaggctaattctgacgtaagcactctcaattattattagtttcgtagttattcattaaaacgttcactatcaagagggcggaggaatgatgttttttgtccattaacccggaagaagatgcgttgatatgattactttaacaagagaactctactgttgtaatttcccaagcatcgccccggagtattctttcattattacggagcagaatttcatttctcttatatattgctttctaaaaagtcaatgaaagttagctgagaaactgtccctgttcatcaccaaaatcaagtaattggtgattagggacagttttccagctcacttatcattgactttttagaaagaacaataatagagaatgaaatcattgctccaatatgaaaagaatactccggggcgattgcggaaatacaacagtagatttctccttgttaaagtaatcatatcaaacgactctccttccggttaatgacaaaaaagcatcatccatcgtcccctttgtaagtgaacgttttaatgaaactacgaaactttaataataatgagatgcttcgtcagaattagccattaaacaaatggttttatgattaatctgcgtatgaattattttacttggtatcatgccattaattgatcagcttgttcagaaacaatcacgagtttactgctagagttttggttttattcatcagcggatccgctggcaattattttgccatgatcaataatataaacctcatctgcattgtctgcttcttcaagatagggtgtgtcaaaaaatggttaattatttgactttgcaatgaatgcaacaatttccaaattgccgagcgggtttggatatccaaacccgtagttggctcatccaaaaaaataatatcaggttgattaagtagagctcttgctatacaactcgtcgccgtttgcccaccagaaagtcggccgtatttttgattaattaattcagttaacccgatttttgaatcaaagcatcaatatgattagatttggcttctttataaagtttattgcaatactcaaattttccataactgtcaaatcattatctaaaatacttgttggaataccatgctaatctttatgtctggtttcatctgatcattccactggttggatttaaatctttgtgagcatcgatatagtggttgttccagcgccatgggtcctagtagagcgtaagcttccttcttgatgctaaatcaatatgtcaaccaccactttgattgataagttttagtaagtccttgtttgaatgatcattatgtcccctctcaaactagtataacgtaatatagcattaaatctcatctttttatatgcacttctgcgatatctgataaaagttgttcgcttaataccggtattacgggcgacgtctacatcactcatgcccgtctgataaagcttaaaagcatgtagtaagcggggatcattttggtatattggggtttgcgccatgatatttcccctgctgtttggccagaaaaatcccctgttgttgacgctcaataatccgcttccgttcactttcgcctgatacttatacagttcaatgattaagttagtatcagttgacgcaagttaggatccgcaatcccgtcatggacggcaaattaacacacatctagggtggcacctttgttctgaatggtgtcataatcttagttaagtcctggtatttctgcctaagcgatctaattcagtgaccaggacaatatcccctcacgaatataggccaacattttttgcagttctggccgattagtgttagccccacttaattatccgtaaataatttatcaacgcctcttaaagccgtaatgtgcgatctaaatgttgctccttggaatacccacgcgcataaccaattttagccatttccagttctccttttggacagtctcctaatgaacacttttaatgcctagtatagcacagaagcaaaaaaggccaatagggtataccctagtggccgttttatgaagtatagataattactattttagatatatgttctcttggtagttcgttatgtttagataggtatgaatatgaaaatgagaaatcctatagagatagaccagagtttgaatataacaaagggctgtgccggtttttcactgtcgatacaggcgcctttgttatgtcatcgggaacatatatttgataactacgctaacactagtgatatcactattgacggttggtgaagtagtgagaaatttcctataacaaatatggtaatataagggcacggatatctttagtattgcaatgtcttagataaagacatttaaataaatagacacagcaaaaaagcactcgaatttttttcggagtgttttctttgtctgaaaccgtaattagttagccttttcattcgctttcttaacagcatctttcaatgcacgtttagctgatgcacctgaacagcatcaacatcatatgttctttatcaaccattgctttaggtattgtcttaatagcatctggcaccaatacctgattcgcgttgcttttaagaaacttcaacattttgctgtgtgttctcatcaacagtaacacgacggtcactggtagcgcattccttcatcatgagttccaatgtatgggtttttaccagcagtaaattatggagtctttctcttcggttctgatgcaccagattcagcatctggtttagtttctatttgcttgatataagattctaaacctgagattctcatttgtttaggtttaagtgcagcattttgtcacggcaatgttaccaaagatttataaacattcagctaagatcctcacagcttgaataacgaccggcagatacaccgcgcctaattcactgccggcactgtaaggtgaccaattggtgatatctgaatctaatattcagctccttgagtttctccggtccaaccttgagtgttaagaacggtttgtttgaacagcaaagcctagtatggaccctgttcataaatgcagttaagcttctccatacgggtatgcatagtcatctatttcatgcaaattattaacagtcagcacagtttcatttcaagacatcaacctagcttaccacatcttttagctaattctttaatgttattctgacaattaattacggtttttctaagaatttggagctagattcccctctttttcacgaaacattttcatatggcttttggtcaaaaataatacgtggtatgatctgattttgacgggtactgttccaaatccgtggctttacgtaaattgaccgtagacggttgtaggttcatctctgggtaataacgtagaaccgttcatccccagcagaagacacttctcattagagcttcgctagtcggctagagattaatctgccttgtgatgcctggtttcaggctcttgagactgcttacatactcatgataacatttcctcatgattcaaaagcttattcatatgccaatatagagcgccaagcgtctgcccacaagtttgaatccccacttaccttactttgcatagatggcatgccaatggggaagctttagaagcacctaagtaatcttcaatcatttcttgattattttcaaaaccaccagtagcagaaactacagccactgtttgcagtaatatttctaacacatgttcatgttcgattgaacaccaacaagttattatcgttgtccataattaaaatgcttagtgtgtgagtaataccaaacatcaatattgtctctcttcaagacttctttcttaagagtttcctagaccagcatcaagaagcctaaggtaacacctataccatcatgtttttcgctaccaggataatccttatattcaacggtattatcaaccaaaggccttatgaaatggaccaaacttaaggattatttagaagtcattctatagatgaataaggatttcaacatttaaatacttttgtaagtaagctagaacatggttggccatcccttcaacaaaggtatctgccgaccatcttgacaggcgtacataggcttagttaggctgcaaaatattctttttcggaacactaatcttcggtagtgagaaatcatttgtgctgagcgtaacgggtgttacccaccttgcataaccttccaggagcgctatcactaatatgactgttggcaccttcatctgcagcaaaacgcgcagctgagcgcacctgcgaccaccaaggcctaaaactctagtaacatcaatagtttttttgtcaaaagttacattatccttattgtttaaatctggacataattatcctccaaactataatcaaagtgatatgatttcataataaaccgattacaaatatgatattattgcaataaaaaatggcttacgtacattgatcaaatacacatttattattccaaaagagtatatagttagacaaataatggctcgagaacaataatacatataccaaaatctatcaaattgtaagtcttggtcgttcataaaccgacattgccaatcgacttatcctcagcaacaccgtaatggttgtagtaaggaaattccacaagcagagtagtgaaaatatcacaataaacacttgcctccgaaagcatattacagatttcaaactcaccagaagctggcgatggttattcttgaaagtttagagaacagctgagtagaactacgaatcatctactaatagatcttgctcttagagataattcagcaatgcgacttaaaatgctactaatcagcgcagtggacgactctttatggcgattatatttacaaaatatcttcaacaaaagaaagctcccctctattagaccttcgaattaactgaaagtcactaccgatcttggccggaacaataaatcgttaacagcgggaaatagattattgctggctggaaagatttaaaattagaaatgattgttagcatatagacatcactaatatgttctattttttctaattccagctacatcatccctatattcaaaaacaaacacatgctgaaatctataactaaagatgatttaaccaagtttaataatcaaaactttgtatctttgagctgacgattcattctttcaaaaattagttgatcatatgttgttgatacaatgttcaagcaaggaaagtctttaaagtagacaaccatggttggtagtactaaaagctgcggctcaggacgctgtggtattttttgtcacaagttatgatttgcagaaacatggatggcaagaagccatttaaacttagaaataacctactacctactaaactttgacataagcagtttcctataactacaaagctaagcaactctgattaaagaaataggctaacgtctaaggaacgttgaaagagcatacggcaaaaaagcttgggaataattttaaaatcaaaaaggcttgatctacctgatatgaagttgaacccttaaatggactggattaacacaaccggaacgtaggtgtagggacggtaggcaggttcaatcaaacatcgcaaaacttaatttaggcgtcaagctttaacttggacagcaaacgaactttcctttttttgctcttgaaaccctttactttgctggtttccccttggtgaccagcgcttaaatgcaggtttacagcgtctggctacccatttcttgggtagtggtaaaggtcctcgccttgcttgggtttcacaatgtaaaactttttgatttttatgacagttacttgtggtgtttctaaagacacctcggcaactttttgcgcttgctgttggtgattgatttgttgcttaatggcctgcactgccagttaagttgtgtgggaacatcagcgtcaattttcactagcgaacttcttaactttggtctcaacaagtattccgtggtgcgttattcgcggtactgatttctgtaacgctgtcccatttagccgtccatttctggtactagttagcaaggtgttctcggcttcgaccggccttgtaatagtgtgatcccagctattctacctgacagtgcagcttatttttcagtggacgacgatagccgcgtgcttttaacacttcagtccattggcccgggtcgcacttgtcccaatgccttgccatacatctttgagaattgcctgggcagcttcaatcatcaagcggtttgccagcagaagtccttcatggccgtaattcaggtccttcggtaaaagtaccggtggtgtactggtttctttttgcgcctgccgtgagtgagttgctggacttgatcacctgttgaacgaagcggtttaaagtttgactacttctctgctcgttttggttcatcaaaataaagcttgccagccttgttagttgggaccttaccggtgctttaattggcgtgcgccaacctgtggtgctaatggtggtttcttctgtactcgctacggatcagcaaaacgctaaacgtcggtcttaaaaacaagtcatagacttgttttgctgtaatttaggataaggtcagctaattgatctttcggtcgggtacgatgttgtagtccatgataatggcgtgtggtttcttcacaccctctttacattaacagtacgcgcttatttggggcggtattgggttaaagcgatttgtgttcagtttttagttagagccaaccccaagtatctcgtcagattagccactaaaataatacaaatctcatcagtatagaagccacaatcggtgcggggattaactgaggcagttttgtcttgataagctttgaatagacgctaaggtttggctggcgtcgggcgtgataacggtttattcatggcactttgggagactagatagcgagaatatgttatggactagctcgtttgtttgccgttctgcacctttgttccttaacctagcgcttatttgtggtggtattggttaaagcgacttgttttagagacgaccccacatacttcgtcagattagccactacatactcaaattcttcatcagtgatatacgcacaaatcggtgcgggggataatcagcaactggcttcatataaatttgaatgtccgctacggtttggctggcgctggcggataacttgattcatggcactttggagactagatagcgtaatagttggggacctagctcggttttttgtctctgtttttggacggccttgaattaaccccccctgtgacgcttctgaacgcgttagcttgcatgaatgtcattagaccctgtttcgcgtctttaaaccgctgatagggggttaattttgcgagaattttgctgattagaagaattttcagcatttagttcaaaatagggttgcggcttacagttcttgattgcctgggtccttttgatagacccattacagttggcgtcctggcaacgcggcccaattgattataccccgcgtaccccgttttgtctggttctgtgtgcaaagttactcagggagagtgcaacctgtagcatgaattgaaactggcgttttcagatactgaggttgtaacgcaagtgagagagcctcctgcaaaaaaattaatcacttgatttcttgaaattggccctttcctttcatgcatctatcatgctgaaaccctcccctttatcaaattcagtatacagtgatgccctctccctgagtaacctttgcacagaacaagcaaaacggggtactcggggttcatactcaattggtctcgtgcagacgccaaccttgatatattgtctatcaaagggaccatgcaatcaaaaactttaagccggaaccctatttttgaactaaatgctgaaattcttggctaagcgcaaaattcttcgcaaaattagacccctccagcggtttaagaggggggggcgaaaacagggcgggtaatgacattcatgcagctaacggcgttcagaaaggctcacaggtgtggtttatcaggaacgtccagcgaaacaagacaaaaat
